United States Patent
Agan et al.

(10) Patent No.: US 9,430,610 B2
(45) Date of Patent: *Aug. 30, 2016

(54) RE-SEQUENCING PATHOGEN MICROARRAY

(75) Inventors: Brian K Agan, San Antonio, TX (US);
Eric H Hanson, Las Vegas, NV (US);
Russell P Kruzelock, Helotes, TX (US); Baochuan Lin, Bethesda, MD (US); Robb K Rowley, Las Vegas, NV (US); Donald Seto, Manassas, VA (US); David A Stenger, Herndon, VA (US); Jennifer Johnson, Finchville, KY (US); Clark J Tibbetts, Sperryville, VA (US); Dzung C Thach, Annandale, VA (US); Gary J Vora, Washington, DC (US); Elizabeth A Walter, San Antonio, TX (US); Zheng Wang, Burke, VA (US)

(73) Assignee: The United States of America, as represented by the Secretary of the Navy, Washington, DC (US)

(*) Notice: Subject to any disclaimer, the term of this patent is extended or adjusted under 35 U.S.C. 154(b) by 443 days.

This patent is subject to a terminal disclaimer.

(21) Appl. No.: 12/100,519

(22) Filed: Apr. 10, 2008

(65) Prior Publication Data
US 2009/0170717 A1 Jul. 2, 2009

Related U.S. Application Data

(63) Continuation of application No. 11/177,646, filed on Jul. 2, 2005, now abandoned.

(60) Provisional application No. 60/590,931, filed on Jul. 2, 2004, provisional application No. 60/609,918, filed on Sep. 15, 2004, provisional application No. 60/631,460, filed on Nov. 29, 2004, provisional application No. 60/631,437, filed on Nov. 29, 2004, provisional application No. 60/691,768, filed on Jun. 16, 2005.

(51) Int. Cl.
C12Q 1/68 (2006.01)
G06F 19/22 (2011.01)
C12Q 1/70 (2006.01)

(52) U.S. Cl.
CPC ............ *G06F 19/22* (2013.01); *C12Q 1/689* (2013.01); *C12Q 1/6888* (2013.01); *C12Q 1/6893* (2013.01); *C12Q 1/701* (2013.01); *C12Q 1/6874* (2013.01)

(58) Field of Classification Search
CPC .................................................. C12Q 1/6883
USPC ........................................................ 435/6.1
See application file for complete search history.

(56) References Cited

U.S. PATENT DOCUMENTS 5,932,220 A * 8/1999 Barbour et al. ........... 424/190.1
6,228,575 B1 * 5/2001 Gingeras et al. ................. 435/5
(Continued)

FOREIGN PATENT DOCUMENTS

EP 1327691 7/2003

OTHER PUBLICATIONS

PCT search report and written opinion in PCT/US05/24054.
(Continued)

*Primary Examiner* — Betty Forman
(74) *Attorney, Agent, or Firm* — US Naval Research Laboratory; Joseph T. Grunkemeyer

(57) ABSTRACT

The present invention relates to pathogen detection and identification by use of DNA resequencing microarrays. The present invention also provides resequencing microarray chips for differential diagnosis and serotyping of pathogens present in a biological sample. The present invention further provides methods of detecting the presence and identity of pathogens present in a biological sample.

13 Claims, 13 Drawing Sheets

(56) References Cited

U.S. PATENT DOCUMENTS

| | | | |
|---|---|---|---|
| 6,344,316 B1* | 2/2002 | Lockhart et al. | 506/9 |
| 7,695,941 B2* | 4/2010 | Lin et al. | 435/91.2 |
| 2004/0014095 A1* | 1/2004 | Gerber et al. | 435/6 |

OTHER PUBLICATIONS

Search Report in EP application No. 05857511.9.
Examination report for NZ application No. 552432.
Gingeras et al., "Simultaneous Genotyping and Species Identification Using Hybridization Pattern Recognition Analysis of Generic Mycobacerium DNA Arrays" Genome Research, 8, 435-448 (1998).
Hacia, "Resequencing and mutational analysis using oligonucleotide microarrays" Nature Genetics, 21, 42-47 (1999).
Wang et al., "Microarray-based detection and genotyping of viral pathogens" Proceed. Nat. Acad. Sci. USA, 99, 15687-15692 (2002).
Wong et al., :"Tracking the Evloutino of the SARS Coronavirus Using High-Throughput, High-Density Resequencing Arrays" Genome Research, 14, 398-405 (2004).
Zhou et al., "Algorithms for high-density oligonucleotide array" Current Opinion in Drug Discovery & Development, 6 (3), 339-345 (2003).
Office action in JP2007-520488 (Feb. 28, 2012).
Examination Report in EP05857511.9 (Jul. 18, 2012).
Office action in KR10-2007-7002788 (Jul. 31, 2012).
Office Action in KR 10-2007-7002788 (Dec. 19, 2011).
Warrington et al., "New Developments in High-Throughput Resequencing and Variation Detection Using High Density Microarrays" Human Mutation 19:402.409 (2002).
Office action in JP2007-520488 (Mar. 1, 2011)—Japanese and translation.
Office Action in IN 145/KOLNP/2007 (Oct. 31, 2013).

* cited by examiner

Fig. 1

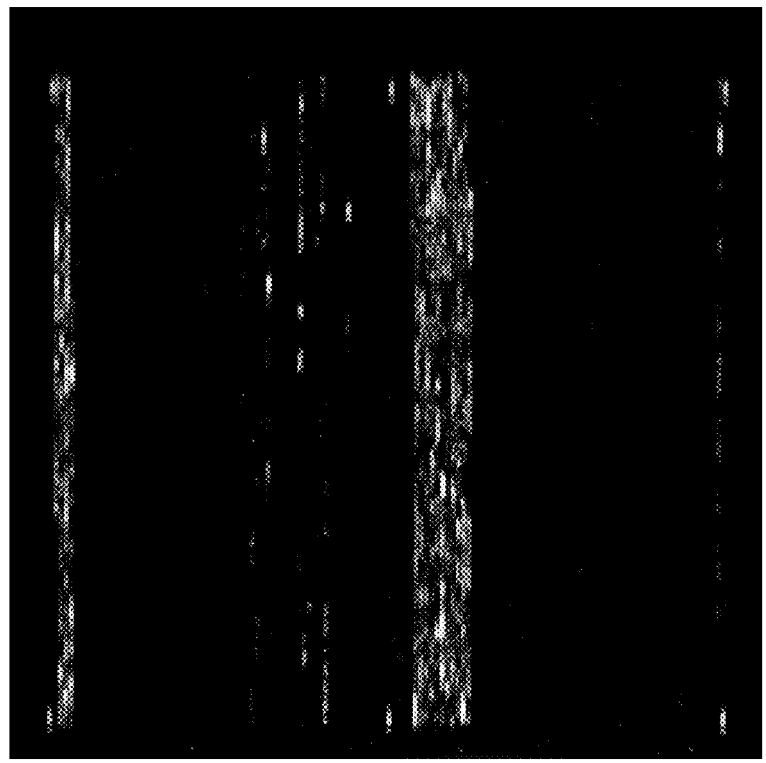
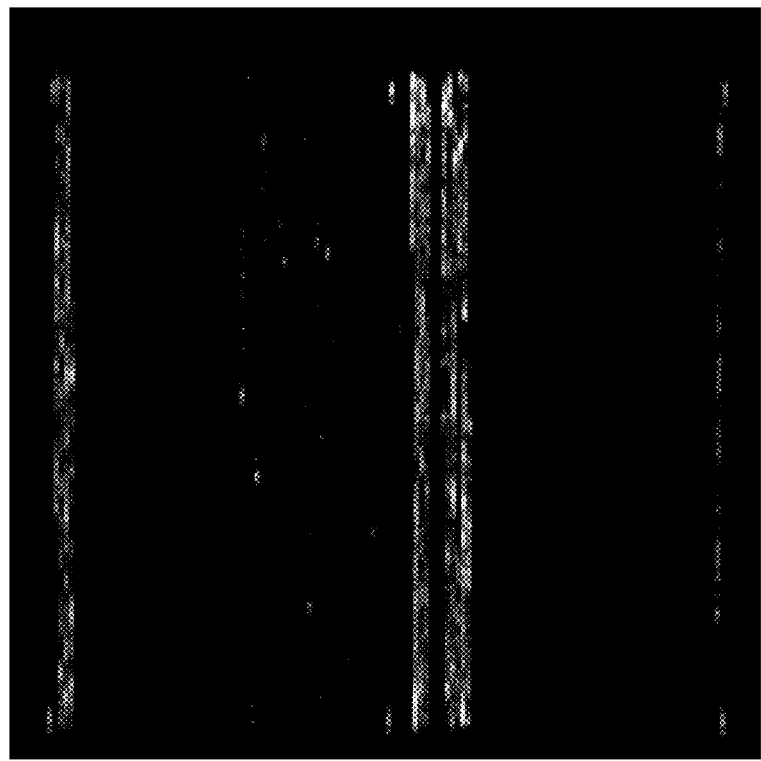
Fig. 3D
Fig. 3C

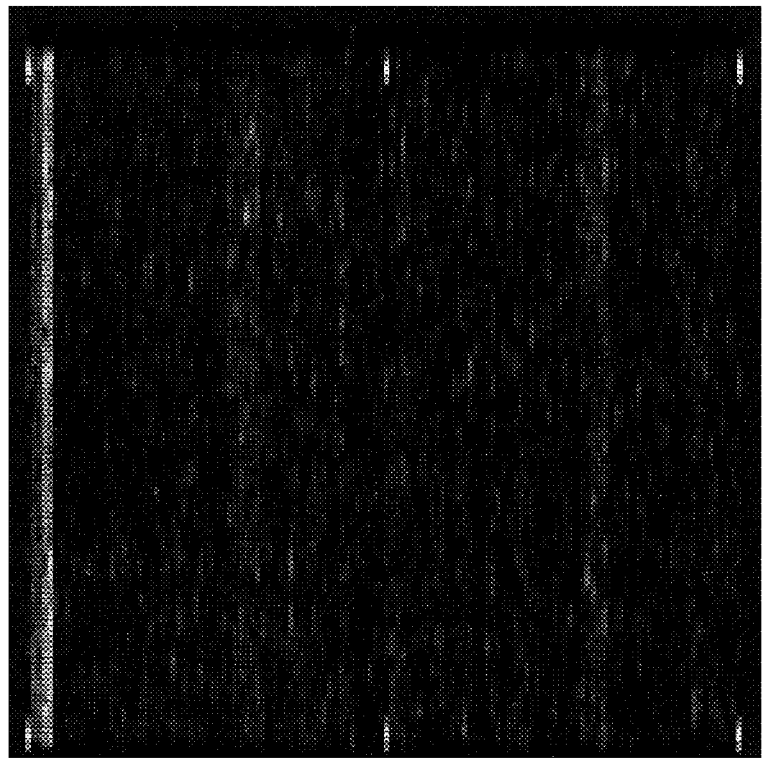
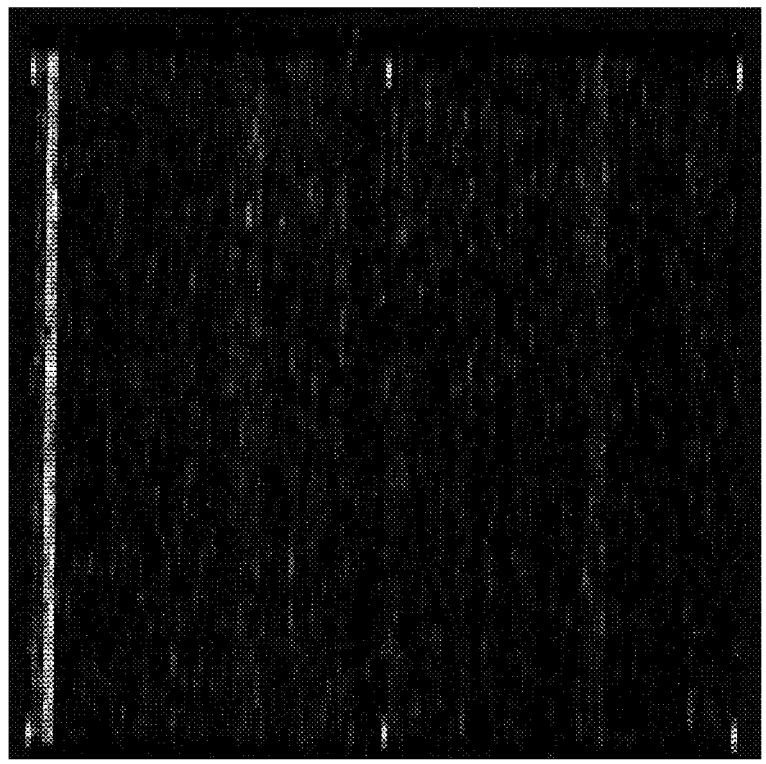

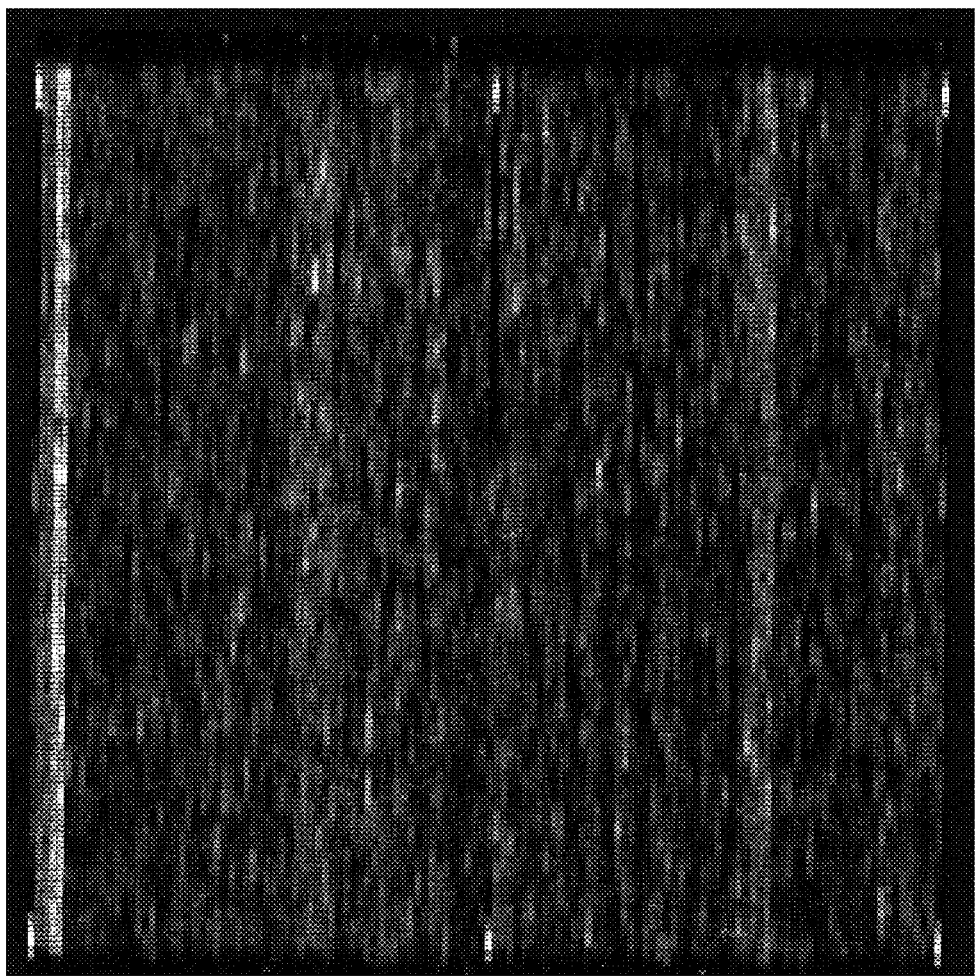

RE-SEQUENCING PATHOGEN MICROARRAY

The present application is a continuation application of U.S. application Ser. No. 11/177,646, filed on Jul. 2, 2005, incorporated herein by reference, which claims priority to U.S. provisional Application Ser. No. 60/590,931, filed on Jul. 2, 2004, U.S. provisional Application Ser. No. 60/609,918 filed on Sep. 15, 2004, U.S. provisional Application Ser. No. 60/631,437 filed on Nov. 29, 2004, U.S. provisional Application Ser. No. 60/631,460 filed on Nov. 29, 2004 and U.S. provisional Application Ser. No. 60/691,768 filed on Jun. 16, 2005.

REFERENCE TO SEQUENCE LISTING

The present application includes a sequence listing electronically filed concurrently with the application. The entire contents of that accompanying sequence listing are incorporated by reference into this application.

FIELD OF THE INVENTION

The present invention provides pathogen detection by use of DNA resequencing microarrays. Preferably, the present invention provides for simultaneous detection of multiple pathogens. The present invention also provides resequencing microarrays and microarray chips for differential diagnosis and fine-scale discrimination between closely related pathogens present in a biological sample. The present invention further provides methods of detecting the presence and identity of pathogens present in a biological sample. The invention enables diagnosis and surveillance of known pathogen sequences and pathogens that may be identified due to unanticipated sequence variations, as well as mixtures of such pathogens. Resequencing, combined with several amplification strategies, allows simultaneous clinical diagnosis and performance of traditional surveillance assays for serotyping, antibiotic resistance profiling, genetic drift/shift analysis, forensics, and rapid detection of biological terrorism events.

DISCUSSION OF THE BACKGROUND

As we move through the biotechnology age fostered by the human genome project a premium has been placed on the development of high throughput methodologies to obtain and analyze sequence information. To meet this demand, the multifunctional DNA microarray platform has gained notoriety leading to an explosive growth in application methods using the same.

More importantly, the evolution of world events and the emergence of bioterrorism in mainstream society have led to a growing sentiment amongst the scientific community and lay people alike that new, rapid, and accurate techniques for biological threat identification and eradication must be developed. The concept of a microarray used for broad-spectrum pathogen identification has considerable and obvious appeal to both medical practice and national defense. It is within this framework that the present inventors have endeavored.

Heretofore, for the purpose of pathogen identification, approaches generally rely on the ability of immobilized "probe" DNA sequences on the surfaces of microarrays to hybridize with complementary genomic "target" that is uniquely identifying of a particular category or specific strain of microbial pathogen. Various microarray technologies have been developed for this purpose, varying in the density of probes and the time ranges required for assay completion.

One technical challenge for pathogen detection with microarrays arises due to the difficulty in obtaining samples with a sufficient quantity of pathogen nucleic acid. Thus, for a majority of sample types, some sort of target amplification will likely be required to provide sufficient copies of pathogen gene markers for detection by microarray hybridization. Unfortunately, conventional methods for this amplification do not scale well in comparison to the number of probes that can be placed on a microarray chip. However, the most commonly employed means of providing sufficient quantities of genomic target to detect hybridization relies upon genotypic identification methods that utilize molecular biology-based techniques, such as the polymerase chain reaction (PCR). These techniques offer several potential advantages over conventional microbiological approaches. Nucleic acid amplification strategies base pathogen identification on the detection of genetic information contained within the organism, such that culturing the organism is not required.

Although PCR-based assays are sensitive, accurate, and rapid, these methods also introduce a new set of problems. As successful identification depends almost entirely on appropriately chosen primer sets, as PCR-based testing requires assumptions about the exact sequences pertaining to the identity of the target organism(s). Consequently, there is a critical need for advanced diagnostic systems that can detect both assumed and unanticipated pathogen sequences. DNA microarrays, which enable the simultaneous interrogation of thousands of genetic elements, address this crucial need. Here, the term "microarray" refers to any type of planar substrate or solid beads presenting a high multiplicity ($10^2$ to $10^6$) of individual sites, each presenting nucleic acid probes designed to selectively capture complementary strands of target (i.e. pathogen or host) nucleic acid.

However, the majority of pathogen identification microarrays described in the literature is prepared using oligonucleotides that are robotically spotted onto derivatized glass surfaces (typically 3×1 inch microscope slides). This approach allows the most flexibility with regards to the size of the oligonucleotides that are deposited, ranging from 20-mers to cDNA PCR products of several thousand base pairs (bp). With few exceptions, the detection event is an increased level of fluorescence originating from a spot following hybridization of a fluorophore-labeled target nucleic acid.

Short (14-25 mer) oligonucleotides, immobilized inside acrylamide pads, have been applied extensively to pathogen identification (Strizhkov et al., 2000; Vasiliskov et al., 1999) in a collaborative effort between Argonne National Lab (DOE, USA) and the Engelhard Institute of Molecular Biology (Moscow, RU) under the leadership of Andrei Mirzabekov. In addition, low-density microarrays (several hundred features per 3×1 inch microscope slide) have been used for determination of drug resistance determinants (Volokhov et al., 2003). One distinguishing aspect of this body of work is the use of three-dimensional polymer matrices for probe immobilization instead of two-dimensional planar surfaces.

More recently, Cherkasova et al have described the use of glass-immobilized short oligonucleotide spotted microarrays to map poliovirus mutations using overlapping 14-25 mer probes (Cherkasova et al., 2003). Two variations of this approach have been used: (1) Microarrays for Resequencing and Sequence Heterogeneity (MARSH) assay, and (2) Microarray Analysis of Viral Recombination (MAVR) assay.

MARSH uses a set of overlapping (at half length) nucleotide probes for individual gene sequences. Hybridizations patterns allow the detection of single point mutations or substitution/deletion events to a resolution of half probe lengths (e.g. 7-10 bp) but does not allow for exact determination of position(s) or the nature of the mutation. Accordingly, conventional DNA sequencing technologies must be employed subsequently to determine these changes. MAVR uses organism-specific oligonucleotide probes that cover the entire genome at ~150 nt spacings and is used to detect large scale genetic recombinations.

The DeRisi group at UCSF pioneered the use of long (70-mer) oligonucleotide probe microarrays for broad-spectrum pathogen identification (Wang et al., 2002; Wang et al., 2003). The use of long (70 nt) oligonucleotides bears implicit advantages and disadvantages. One advantage is that higher degrees of sensitivity can usually be achieved with 70-mer probes compared to shorter ones (e.g. 20-25 mers). However, specificity is reduced because 70-mer target/probe hybridizations are generally insensitive to significant numbers (e.g., 7-10) of single base mismatches, whereas shorter probes provide much greater sequence specificity.

DeRisi's group described the use of spotted microarrays having 1,600 different 70-mer oligonucleotide probes to identify a variety of viruses responsible for common respiratory infections (Wang et al., 2002). The probes were selected for each pathogen using an algorithm that located discriminatory sequences from a list of known viral genomes. A serial combination of a previously described (Bohlander et al., 1992) method and subsequent PCR/Klenow fragment-based amplification was used to achieve non-biased amplification of both viral RNA and DNA, allowing generation of sufficient amounts of target amplicons for successful microarray hybridization and detection via fluorescent label. (N.B. This protocol was placed into the public domain via the DeRisi lab website (http://derisilab.ucsf.edu)). The time required from sample preparation to obtained result was approximately 24 hours. Because exact sequence information was not attainable from such arrays, pathogen identifications were made on the basis of a hybridization pattern that could be empirically determined for each pathogen or strain. In a related report from the same group (Wang et al., 2003) similar microarrays were prepared using highly conserved sequences in an effort to capture as many microbial species as possible from a sample. Following physical removal of the pathogen sequences from the microarray, the sequences are cloned and sequenced using conventional DNA sequencing technologies. No measure of analytical/clinical sensitivity or specificity for pathogen detection in clinical specimens was provided in the work from the DeRisi group.

In contrast to the above-mentioned approaches using spotted microarrays, Affymetrix, Inc. (Santa Clara, Calif.) uses high-density probe fabrication technology to construct "tiled" microarrays using 4 probes each in both the sense and anti-sense directions for each nucleotide base to be resequenced. Thus, single base substitutions are directly detected by the hybridization pattern (for additional information see Affymetrix CustomSeq design manual). Several groups described the use of tiled microarrays for pathogen genotyping. (Kozal et al., 1996) utilized this type of microarray to measure mutational drift in HIV while Gingeras et al (Gingeras et al., 1998; Troesch et al., 1999) used a tiled array of 65,000 oligomer probes to resequence and accurately identify 70 clinical isolates of 27 mycobacterial species and 15 rifampin-resistant *M. tuberculosis* strains. More recently, Andersen et al. (Wilson et al., 2002b) described the use of tiled Affymetrix microarrays for the identification of biological warfare agents. Their approach relied entirely on the use of specific PCR reactions performed in parallel to generate sufficient pathogen target DNA for microarray hybridization. In all cases listed above, specific PCR primers were used to amplify DNA targets prior to microarray hybridizations, through the use of conserved primer sites, or in the work of Andersen et al. (Wilson et al., 2002a; Wilson et al., 2002b), by carrying out up to ~150 different PCR reactions in multi-well format and pooling the amplicons.

U.S. Pat. No. 6,228,575 B1 describes the same data as described by Gingeras (Gingeras et al., 1998) and Troesch (Troesch et al., 1999). In this patent, which is incorporated herein by reference in its entirety, target pathogen sequences are tiled onto arrays. Because several types of variations (esp. insertion/deletion or frequent multiple substitutions) in pathogen sequence can perturb hybridization patterns, Gingeras et al. used differential measures of specific pathogen hybridization patterns to identify individual mycobacterial variants. That is, identifications required a priori knowledge of a differential hybridization pattern that was empirically determined in ground truth experiments.

As stated above, there is a critical need for advanced diagnostic systems that can detect known and pathogen genomic sequences as well as variations of those sequences. More particularly, there remains a critical demand for DNA microarray techniques that are fast and reliable, but are free from the systemic bias flowing from the specific PCR based methods that have heretofore been employed.

SUMMARY OF THE INVENTION

It is an object of the present invention to provide the following preferred embodiments:

A. In an embodiment of the present invention is a resequencing DNA microarray chip of multiple groups of oligonucleotide primers of a length ranging from 13 to 70 nucleotides immobilized to a solid phase support, wherein each group of oligonucleotide primers is selected to span a particular region of the reference sequence, occupying a discrete area of the array (e.g. a tile), and comprising at least four sets of primers arranged in a parallel fashion on the chip: 1) a first set that is exactly complementary to the reference sequence; and 2) three additional sets of primers, each of which is identical to the first set of primers but for the nucleotide at a central position, which is different in each of the three sets such that all four conventional nucleotide bases are present on said array.

a. In a preferred aspect of this embodiment, the length of the oligonucleotide primers is 25 nucleotides.
  b. In a preferred aspect of this embodiment, the region of the reference sequence that is spanned by the oligonucleotide primer moves by (n+1) nucleotides across the reference sequence for each adjacent tiled region across the microarray surface.
  c. In a preferred aspect of this embodiment, the resequencing DNA microarray contains 18×18 micron features.
  d. In a preferred aspect of this embodiment, the resequencing DNA microarray contains 8×8 micron features.
  e. In a preferred aspect of this embodiment, the sequences selected for tiling are a single gene or subsequence that may represent a much broader class of organism genus, species and subspecies.

f. In a preferred aspect of this embodiment, the sequences selected for tiling are "prototypes" representing genotypes of pathogen families.
g. In a preferred aspect of this embodiment, the sequences selected for tiling are "prototypes" representing a family or group of adenoviruses.
h. In a preferred aspect of this embodiment, the sequences selected for tiling are "prototypes" representing a family or group of influenza viruses.
i. In a preferred aspect of this embodiment, the sequences selected for tiling are a single gene or subsequence unique to an individual pathogenic strain.
j. In a preferred aspect of this embodiment, the sequences selected for tiling encode a drug-resistance marker.
k. In a preferred aspect of this embodiment, the resequencing DNA microarray is a Version 1 Respiratory Pathogen Microarray (RPMV1).
l. In a preferred aspect of this embodiment, the resequencing DNA microarray is a Version 2 Respiratory Pathogen Microarray (RPMV2).
m. In a preferred aspect of this embodiment, at least one common pathogen and at least one biological terrorism agent is represented on the same chip.
n. In a preferred aspect of this embodiment, the resequencing DNA microarray embraces any combination of the aforementioned aspects.

B. In an embodiment of the present invention is a kit containing (a) the aforementioned resequencing DNA microarray, and (b) reagents suitable for specific hybridization of target sequences to the probe sequences present on said resequencing DNA microarray.

C. In an embodiment of the present invention is a method of detecting the presence of a drug-resistance marker in a microorganism or a microorganism belonging to a particular class of organism species or subspecies, wherein the method comprises: (1) providing a resequencing DNA microarray as described above; (2) contacting to said resequencing DNA microarray a unknown sample, (3) hybridizing the contents of said unknown sample to the probe sequences immobilized on said resequencing DNA microarray under suitable conditions and for a suitable time; (4) detecting the presence and/or identity of a drug-resistance marker in a microorganism or a microorganism belonging to a particular class of organism species or subspecies in said unknown sample, and (5) detecting a sufficient amount of pathogen sequence in order to allow a forensic assessment of the possible source(s) of pathogens.
a. In a preferred aspect of this embodiment, the method is for detecting the presence of a particular pathogenic species.
b. In a preferred aspect of this embodiment, the method is for detecting the presence of a drug-resistance marker.
c. In a preferred aspect of this embodiment, the hybridization time ranges from 15 minutes to 24 hours.
d. In a preferred aspect of this embodiment, the unknown sample is a biological sample, including a nasal wash specimen, a throat swab, a blood sample, and a sputum sample, or an environmental sample, including a soil sample, an air sample, and a water sample.
e. In a preferred aspect of this embodiment, prior to hybridizing the unknown sample is subjected to one or more of the following steps: (1) isolation, (2) enrichment for target sequences of interest, (3) amplification, (4) labeling, and (5) hybridization (e.g., subtractive).
f. In a preferred aspect of this embodiment, prior to hybridizing the target nucleic acids of interest in the unknown sample is amplified by specific reverse transcription (RT), PCR, multiplex PCR, and/or random PCR.
g. In a preferred aspect of this embodiment, prior to hybridizing the target nucleic acids of interest, the unknown sample is subjected to a random amplification strategy (e.g., random primed isothermal Klenow polymerase-based, $\phi$29DNA polymerase-based, tandem amplification, multiplex PCR, and total amplification).
h. In a preferred aspect of this embodiment, the DNA present in said unknown sample has been enriched.
i. In a preferred aspect of this embodiment, the target nucleic acids of interest present in said unknown sample are enriched by subtraction of the background nucleic acids from said sample.
j. In a preferred aspect of this embodiment, the target nucleic acids of interest present in said unknown sample are enriched by selective removal of said target nucleic acids from a mixture of nucleic acids presenting said unknown sample.
k. In a preferred aspect of this embodiment, the target nucleic acids of interest present in said unknown sample are enriched by selective capture using probes having complete or partial sequence homnology, followed by amplification and hybridization to the microarray.
l. In a preferred aspect of this embodiment, said detecting the presence and/or identity is by (a) making base calls based on the hybridization response between the nucleic acids of interest in said unknown sample and the probe DNA on the resequencing DNA microarray and (b) determining the sequence of the corresponding full-length gene or genomic fragment by comparing the sequence of the hybridized region to sequences present in a sequence database.
   i. In a particularly preferred aspect, the base calls are made by the Affymetrix GDAS software under "permissive" settings.
   ii. In a particularly preferred aspect, sequence determination is by Resequencing Pathogen Identifier (REPI) software (see U.S. provisional Application Ser. No. 60/609,918 filed on Sep. 15, 2004, and U.S. provisional Application Ser. No. 60/631,460, filed on Nov. 29, 2004, which are incorporated herein by reference in their entirety).
   iii. In a particularly preferred aspect, the sequence database is GenBank.

D. In an embodiment of the present invention is a method of routine diagnosis of common respiratory pathogens and/or biological terrorism agents by using the method of C above.

E. In an embodiment of the present invention is the genomic sequences of thirteen adenovirus strains, which were not known as of the date of the present invention, including: Ad3, Ad3FS_navy, Ad4, Ad4vaccine, Ad4FS_navy, Ad4FS_AF, Ad5FS, Ad7, Ad7FS_navy, Ad7 vaccine, Ad16, Ad1, and Ad21, and fragments thereof.

F. In an embodiment of the present invention is a method of surveillance of common respiratory pathogens and/or biological terrorism agents by using the method of C above.

G. In an embodiment of the present invention is a method of estimating the relative amount of a pathogen in a biological sample containing the same comprising providing a resequencing DNA microarray as described above; (2) contacting to said resequencing DNA microarray said biological sample; (3) hybridizing the contents of said unknown sample to the probe sequences immobilized on said resequencing DNA microarray under suitable conditions and for a suitable time; and (4) quantifying the presence and/or identity of a drug-resistance marker in a microorganism or a microorganism belonging to a particular class of organism species or subspecies in said unknown sample.
  a. In a preferred aspect of this embodiment, said quantifying is by determining the absolute intensity of the hybridization signals on the chip.
  b. In a preferred aspect of this embodiment, said quantifying is by determining the percentage of base calls, both as a percentage of the total tile region size and as a percentage of base calls within a selected subsequence satisfying the sliding window algorithm (i.e., REPI).

The above objects highlight certain aspects of the invention. Additional objects, aspects and embodiments of the invention are found in the following detailed description of the invention.

BRIEF DESCRIPTION OF THE FIGURES

A more complete appreciation of the invention and many of the attendant advantages thereof will be readily obtained as the same becomes better understood by reference to the following Figures in conjunction with the detailed description below.

FIG. 1 shows a graphical description of the Version 1 Respiratory Pathogen Microarray (RPMV1). The geometrical distribution of all tile regions dedicated to each pathogen is represented by assigned colors (right). The Affymetrix spike-in controls are at the top of the microarray (white). Black regions interspersed between tiled regions did not contain probes.

Figure 5B:
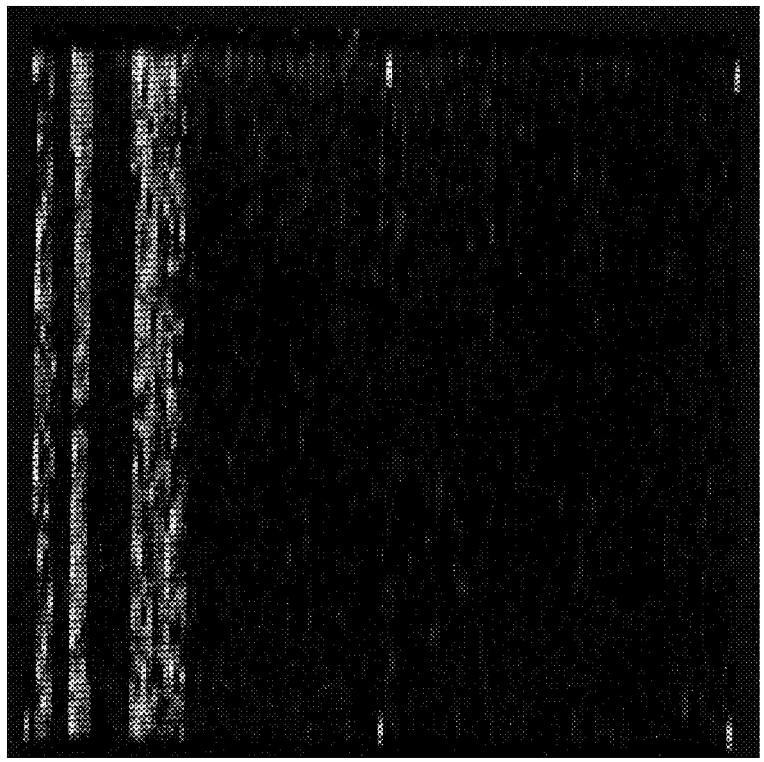
Figure 5A:
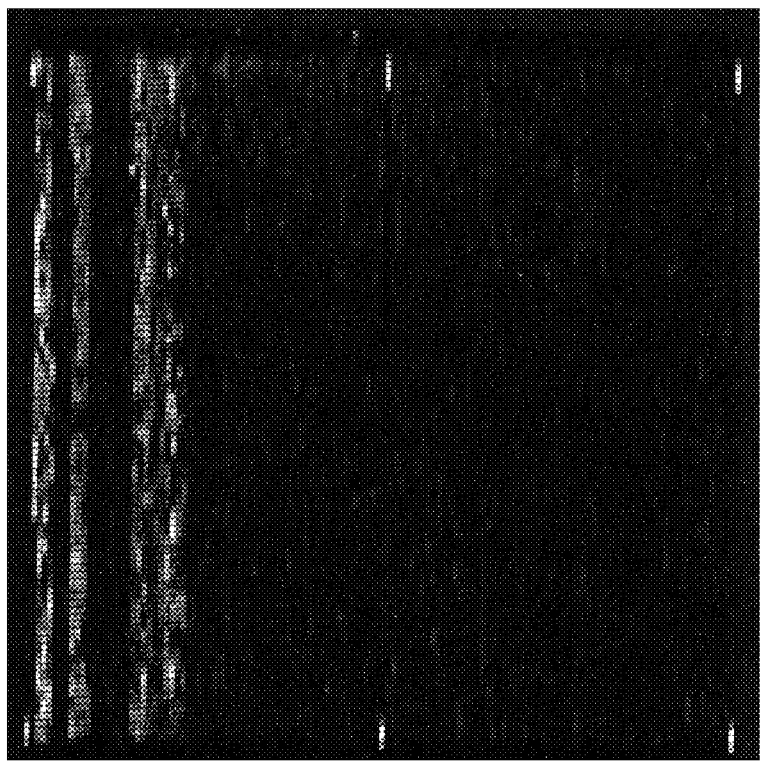

FIG. 5 shows the results of influenza A strain identification as described in Example 5. Aliquots of a nasal wash from an Influenza A (+) febrile patient (confirmed by standard viral cell culturing techniques) who was previously immunized (using A/Moscow/10/99(H3N2))—based vaccine) during the 2003-2004 flu season were amplified using (A) universal (Hoffmann et al., 2001) or (B) multiplex (Offringa et al., 2000) RT/PCR primers, and processed according to the standard Affymetrix CustomSeq protocol. Because both strategies produce amplicons of the entire HA, NA, and M genes, the respective tile regions on the microarrays were almost completely hybridized in both cases. REPI output for both cases showed that the highest bit score for HA3 was obtained for the Fujian/411/2002 influenza strain (ISDN38157_InfluenzaA/Fujian/411/2002_Hemagglutinin_1042) that evaded vaccine protection during the 2003-2004 flu season. The prototype influenza A HA sequence used to define the HA3 tile region, (A/Panama/2007/99/H3N2), was not present in the REPI output for the base calls on the HA tile. Thus, a prototype region for an expected strain of influenza A allowed identification of an unexpected strain.

FIG. 6 shows the results of the reduced hybridization time assay as described in Example 6. In this example, a nasal wash that was confirmed negative for all targets probed by the microarray except the erythromycin resistance markers SPYERMB, SPYERMTR, and SPYMEFAE was subjected to specific multiplex PCR for each of these three markers. The amplicons were then hybridized to separate microarrays for either 16 hours (A) or 15 minutes (B), otherwise being processed in accordance with the Affymetrix CustomSeq protocol. In comparison, the signal intensities for the 15-minute hybridization microarray (B) were lower than those on the control 16-hour microarray (A) (note incomplete hybridization to the Affymetrix control probes at the top of the microarray in (B)). However, the REPI output for each of the three tile regions showed that the highest bit scores in each region were the same for both (A) and (B), although both the bit scores and expect values were lower in the cases of reduced hybridization times. Similar results were obtained for 30 minute and 1 hour hybridizations, with an increase in the number of base calls made with increasing hybridization times. However, this example clearly illustrates the robustness of the method to make fine scale discrimination between targets with a range of different hybridization patterns.

FIG. 7 shows the effects of subtractive hybridization approaches as described in Example 7. (A) Shows the hybridization pattern obtained following total amplification of the isolated nucleic acids from an aliquot of nasal wash from a patient with febrile respiratory illness at Lackland AFB. This sample was positive for Ad4 at an estimated titer of $10^4$ genomic copies per microliter. The high background hybridization across the microarray prevents GDAS from making base calls even though the adenovirus type 4 region showed a discernibly higher signal than that of the overall background. Co-hybridizing the same set of total amplicons obtained in (A) with COT-1 fraction human genomic DNA (B) did little to improve this as again no base calls were made by GDAS. (C) Shows that the use of a magnetic bead-based subtraction alone, prior to total amplification, did not result in a sufficient number of base calls to allow similarity searching. However, through the combined use of a bead-based subtraction (Streptavidin-coated beads conjugated with biotinylated COT-1 human DNA) prior to amplification and co-hybridization with solution phase COT-1 human DNA (D), enough base calls could be made to unambiguously rank the adenovirus 4 Air Force field strain (accession number AY599837) highest in each of three subsequences identified in the Ad4HEXON-1 tile region (D). Moreover, by performing the same set of combined steps using 2 microliters of starting sample material instead of 1 microliter (E), base calling was extended into the Ad4FIBER tile region in addition to Ad4HEXON-1, allowing unambiguous high bit-score ranking for an Ad4 field strain in the Ad4HEXON-1 tiles and in several Ad4FIBER subsequences.

Figure 8B:
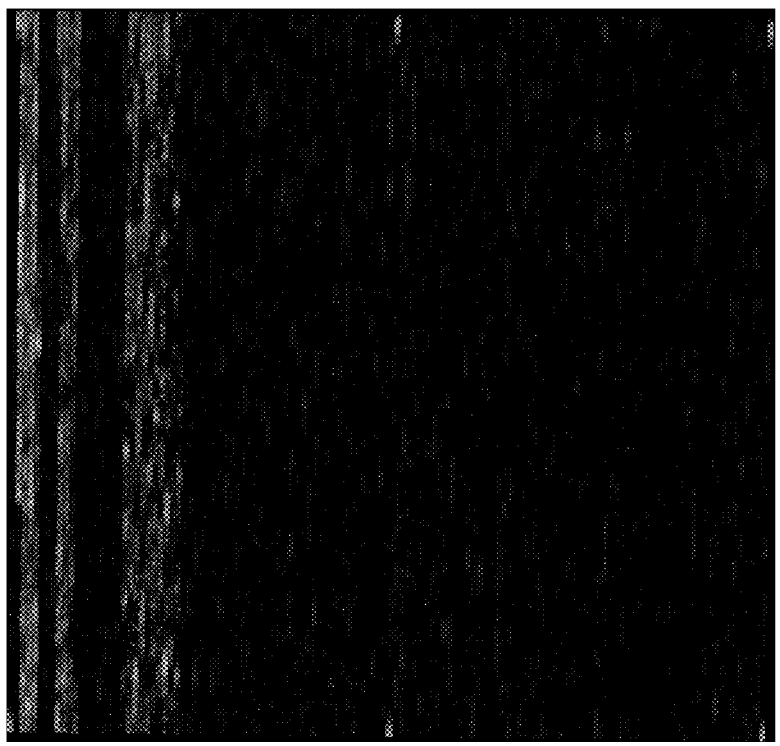
Figure 8A:
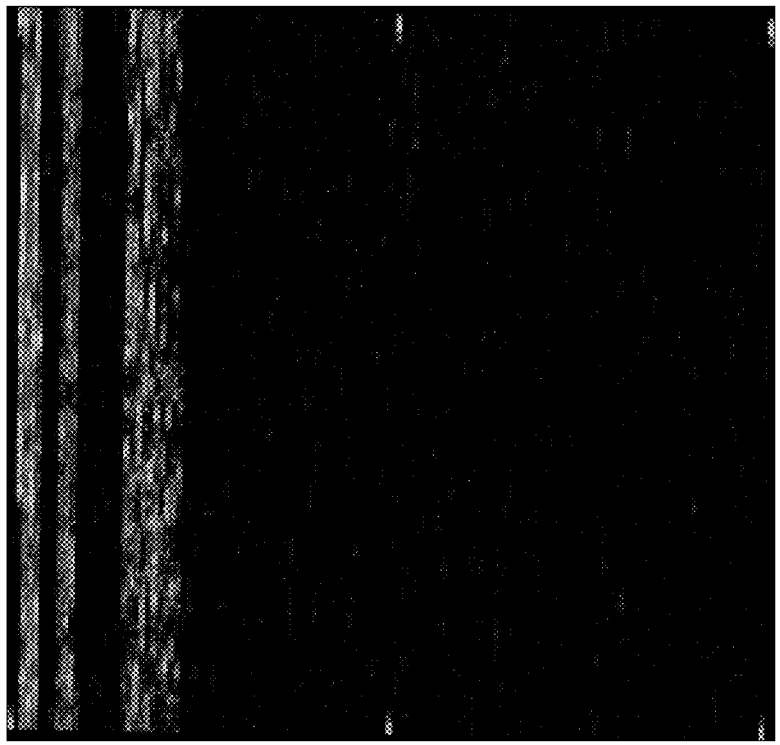
Figure 8C:
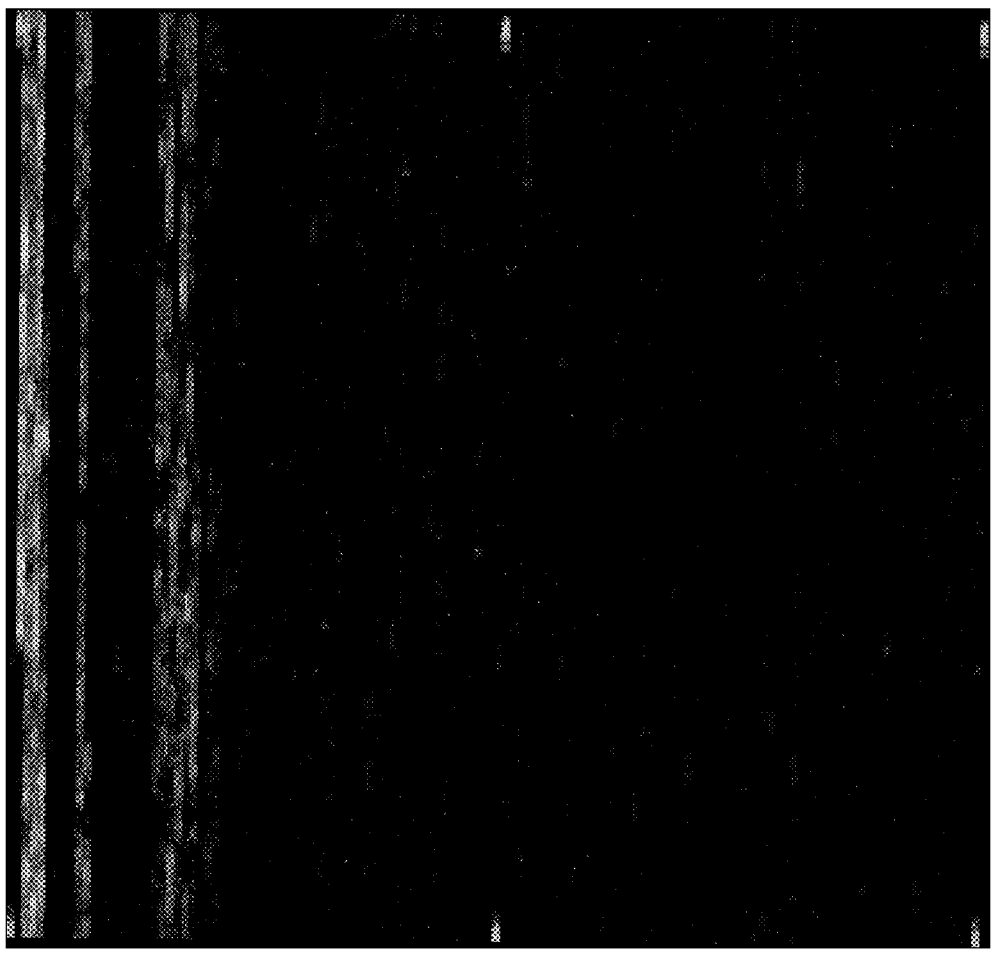

FIG. 8 shows hybridization of Influenza A targets (Fujian 411/2002), spiked into normal nasal wash, following amplification using a recently-described modification (Kessler et al., 2004) of a previous (Wang et al., 2003) protocol for non-biased amplification of viral RNA genomic targets. FIG. 8 (A-C) show hybridization patterns for $10^5$, $10^3$, and $10^1$ plaque-forming unit (pfu) spike-in amounts, respectively (see Example 9). These results demonstrate that the efficacy of the present approach can be retained even when a non-biased amplification scheme is used. This should allow extension of the overall approach to preparation of a multiplicity of unknown RNA targets and for incorporation of this particular protocol into a combined method for universal amplification of both RNA and DNA pathogen targets for the resequencing microarray.

Figure 9:
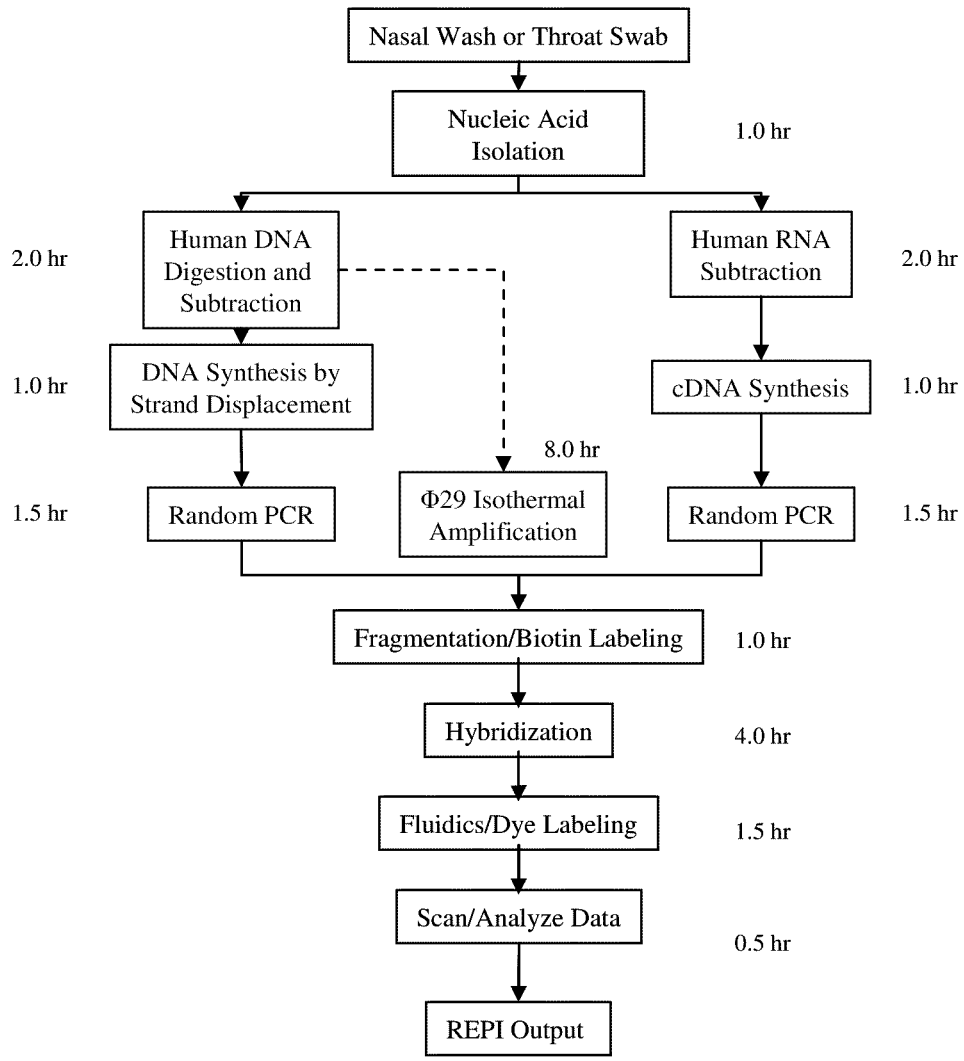

FIG. 9 shows a flowchart representation of an embodiment of the present invention in which the RNA and DNA pathways are converged.

DETAILED DESCRIPTION OF THE INVENTION

Unless specifically defined, all technical and scientific terms used herein have the same meaning as commonly understood by a skilled artisan in enzymology, biochemistry, cellular biology, molecular biology, bioinformatics, and the medical sciences.

All methods and materials similar or equivalent to those described herein can be used in the practice or testing of the present invention, with suitable methods and materials being described herein. All publications, patent applications, patents, and other references mentioned herein are incorporated by reference in their entirety. In case of conflict, the present specification, including definitions, will control. Further, the materials, methods, and examples are illustrative only and are not intended to be limiting, unless otherwise specified.

It is well known that DNA microarrays might be used to analyze the sequence of target nucleic acids from pathogens for diagnostic or surveillance purposes. The effects of oligonucleotide probe sequence selection, length, positioning on surfaces, the physical chemistry of binding, and labeling techniques, have been the topics of vigorous research in the past ten years. However, heretofore, the approaches taken have almost exclusively involved the use of single oligonucleotide probes (13-70 mers) that are specifically designed to hybridize to a single recognized pathogen target sequence with high specificity (13-25 mers) or to a longer stretch of pathogen target with a lesser degree of specificity (70 mers). These microarrays are commonly known as spotted microarrays, but the same content of a spotted microarray can also be embodied in other forms besides two-dimensional planar surfaces, one example being "bead arrays" (Ferguson, Steemers & Walt, 2000).

There have been many fewer descriptions of pathogen identification and characterization using Affymetrix resequencing microarrays. Kozal (Kozal et al., 1996) measured mutational drift in HIV and Gingeras (Gingeras et al., 1998; Gingeras et al., 2001), and Troesch (Troesch et al., 1999) identified mycobacterial species and Single Nucleotide Polymorphisms (SNPs) relating to antibiotic resistance using resequencing arrays. Wilson et al. (Wilson et al., 2002a) used the same types of arrays for bacterial identification using ribosomal RNA and for detection of multiple biowarfare agents (Wilson et al., 2002b).

The use of resequencing microarrays for simultaneous pathogen identification and surveillance has fundamental advantages over single oligonucleotide approaches because detailed target sequence information becomes directly available as part of the raw microarray data. By definition, spotted microarrays having $10^2$ to $10^4$ oligonucleotide probes are incapable of resolving subtle sequence variations for more than 10-1000 base pairs of total target sequence, even if the array were designed with a tiling strategy. Thus, spotted oligonucleotide microarrays that facilitate identification of a broad spectrum of pathogens at an individual strain or SNP level (Cherkasova et al., 2003; Wang et al., 2002; Wang et al., 2003) require that the pathogen target sequence be determined using conventional DNA sequencing technology, requiring specialized equipment, personnel, and time periods of several days.

Accordingly, the present invention generally relates to the detection and identification of bacterial, viral and protozoan pathogens and virulence markers using DNA microarray technology. The present invention also relates to the design, test, and analysis of resequencing microarrays having defined regions that can be used to assign numeric detection probabilities for a large number of specific pathogen genotypes and mixtures of pathogens. Furthermore, it relates to methods required for the processing of both simple and complex (e.g. clinical and environmental) samples for said microarrays.

More specifically, the present invention relates to the use of high plurality resequencing microarrays as a novel class of devices for purposes that would include diagnosis of infectious disease agents and pathogen surveillance. In particular, it pertains to DNA microarrays that employ a large number (hundreds to thousands) of selected "prototype" nucleic acid sequence regions (typically 250-2000 base pairs each) from target genomic sequences to detect and identify a logarithmically larger number (thousands to tens of thousands) of both unrelated and closely related (strain level) microbial pathogens. More particularly, the invention relates to the design of microarrays fabricated to allow a resequencing of the target nucleic acids using a "tiled" probe approach. Yet even more particularly, the invention concerns the design of Affymetrix resequencing microarrays using tiled probes that will allow for analysis of up to $10^5$ to $10^6$ base pairs of target sequence.

In a particular embodiment, the present invention provides a method for simultaneously assaying for a large number of pathogens by detecting their nucleic acid sequences and subjecting the detected sequences to an automated similarity search against public domain and private databases. This object is accomplished by a non-obvious adaptation of a commercial technology (Affymetrix CustomSeq™). The program employed, CustomSeq™, was designed for detection of Single Nucleotide Polymorphisms (SNPs) by resequencing target DNA. This so-called SNP-detection calls for: (1) an error rate in base calling that is much lower than the naturally occurring frequency of mutation (in humans approximately (1 per $10^8$ base pairs), (2) amplification of the purified starting material, at a concentration of $10^6$ genomic copies/microliter, prior to microarray hybridization using specific PCR primers, and (3) combination and processing multiple chips for replicate samples by an algorithm that restricts base calls to those having a degree of confidence at which the presence of low frequency SNPs can be deduced. The present inventors demonstrate that Affymetrix resequencing technology can be adapted for insertion into an integrated system for high multiplicity infectious disease diagnostics and pathogen surveillance in a time scale and level of sample preparation complexity that are enabling for point-of-care diagnostics applications. This system is substantively different from the intended use of the Affymetrix technology, and is not obvious to the typical skilled practitioner of microarray technology.

At present, there have been few, but relevant literature descriptions of application of Affymetrix resequencing technology to pathogen identification. From the design, experimental, and analysis standpoints, the present invention has substantive advantages over the prior art in pathogen characterization using resequencing. Kozal (Kozal et al., 1996) measured mutational drift in HIV and Gingeras (Gingeras et al., 1998; Gingeras et al., 2001), and Troesch (Troesch et al., 1999) identified mycobacterial species and SNPs relating to antibiotic resistance using resequencing arrays. In each of these cases, optimized sequences were selected for tiling, based on alignments of the possible target sequences. Specific PCR primers were designed to amplify targets for hybridization. Unknown clinical isolate identifications were made using pattern recognition algorithms based on empirically determined differential hybridization patterns to the arrays. As such, this approach would depend on the amplification and hybridization of the full length of the target sequences, and would not be amenable to: (1) contributions of confounding non-specific binding resulting in lost base calls, (2) incomplete hybridization across the length of the target due to low target concentration or gaps caused by low homology, and (3) compromised hybridization integrity caused by non-biased (total) amplification of unknown target sequences from a clinical or environmental sample.

The method proffered by the present inventors does not share the same limitations as those disclosed in the prior art using resequencing microarrays. Moreover, technology enablements for at least one intended use, namely the simultaneous detection of a large number of diverse pathogen species, have only recently occurred with the introduction of Affymetrix microarrays (18×18 micron features) for CustomSeq™ RPMV1 chip and higher density (8×8 micron features) for Respiratory Microarray Version 2 (RPMV2), allowing 29.7 kb and 300 kb, respectively, to be tiled for resequencing. However, the most significant improvement offered by the present invention is the use of the increased density chips with sequence length-independent similarity searches (BLASTN), which affords that many fewer assumptions must be made in advance of selecting sequences for tiling. Furthermore, the use of length-independent similarity searches (BLASTN) removes the constraint that a particular known subsequence be fully resequenced, making the approach more resistant to variations in target concentration and contributions from nonspecific binding leading to lost base calls.

Thus, in the present invention, sequences selected for tiling are "prototypes" in the sense that a single gene or subsequence may represent a much broader class of organism species and subspecies (alternatively types, strains, variants, or mutants). The resulting method is robust with respect to minor variations in the genotypes of individual pathogens and strains, and enables detection and probable identification among a plurality of candidate pathogens that may not be explicitly represented in the design of the experimental chip layout, including the tiled regions.

The chip layout also takes advantage of partially redundant tile sets (these were discouraged by the manufacturer's design guidelines and by the manufacturer during design), both intragenic and intergenic variation within a single pathogen strain, and between multiple similar or diverse pathogen types. However, the present inventors have determined that the redundancy is important to elevate confidence in results and to minimize likelihood of false positive and false negative results. Advantages of this design/analysis approach will permit incorporation of both conserved and hyper-variable regions of genomes, facilitating group, type, and strain level identification.

There are only a few literature reports describing generic amplification strategies for microarray analysis of microbial pathogens. Wang et al. (Wang et al., 2002) described a multi-step process for amplification of RNA pathogen targets followed by sequential PCR and Klenow fragment-based amplifications, prior to hybridization on 70 mer oligonucleotide arrays. The time and/or number of technical steps required for this amplification were not specified but a subsequent paper from the same group (Wang et al., 2003) reported it to be approximately 24 hours. It was also not specified which of the amplification steps resulted in enhanced detection efficiency. A recent report from our group (Vora et al., 2004) describes a variety of nonspecific nucleic acid amplification techniques, individually and in combination, for hybridization to 70 mer oligonucleotide arrays. There are no known reports of prior art in the area of nonspecific amplification of DNA targets, either purified or in a complex mixture (e.g. clinical sample), for hybridization to a resequencing microarray.

The present invention generally advances the art of generic amplification for pathogen detection by microarrays in several ways: (1) it details specific methods for total amplification of purified or highly enriched pathogen nucleic acids for presentation to a high density short (25 mer) Affymetrix resequencing array, which is neither previously described nor obvious, since the methods are a large departure from the prescribed Affymetrix protocols, and (2) it describes novel alternative approaches to the use of enzymatic processes, competitive hybridizations, and magnetic bead-based subtractive and enrichment steps to reduce background and subsequent non-biased (i.e. total) amplification and microarray hybridization.

The present invention is embodied by a specific set of design and processing methods that enable broad-scale pathogen identification and characterization by utilizing resequencing microarrays. Specifically, the present invention allows for the precise, sensitive, and high confidence identification of a large multiplicity (thousands) of pathogens in a single assay.

In an embodiment of the present invention is a resequencing DNA microarray chip of multiple groups of oligonucleotide primers of a length ranging from 13 to 70 nucleotides (preferably 25 nucleotides, although it is possible and is within the scope of the present invention to use primer lengths corresponding to each integer value within this recited range) immobilized to a solid phase support, wherein each group of oligonucleotide primers is selected to span a particular region of the reference sequence, occupying a discrete area of the array (e.g. a tile), and comprising at least four sets of primers arranged in a parallel fashion on the chip: 1) a first set that is exactly complementary to the reference sequence; and 2) three additional sets of primers, each of which is identical to the first set of primers but for the nucleotide at a central position, which is different in each of the three sets such that all four conventional nucleotide bases are present on said array.

The present invention further provides methods for processing complex clinical samples (e.g. nasal wash) requiring minimal nucleic acid isolation/amplification step(s).

The present invention is distinct from the overwhelming majority of microarray-based pathogen detection schemes because it uses high-density "tiled" microarrays to determine the actual sequences of pathogen genetic targets. It is further unique from other resequencing pathogen identification strategies in a number of important areas, including incorporation of: (1) a high multiplicity of disparate pathogen "prototype" target regions that exhibit little or no discernible cross-hybridization or interference with one another, (2) a high sequence redundancy within closely related pathogens that allows higher confidence identification of specific strain (e.g. adenoviruses or influenza viruses), (3) "prototype" regions of large tiled segments representative of a class of pathogens allowing for the precise identification of specific pathogen strains and the use of specially-designed software to parse and arrange sequence fragments for presentation to similarity search (e.g. BLAST) algorithms, allowing discrimination of pathogen mixtures and recombination events between pathogens, instead of the more restrictive tile selections and differential algorithm described in the most closely-related prior art (U.S. Pat. No. 6,228,575), (4) minimally-biased nucleic acid amplification strategies that allow precise, high-confidence pathogen target resequencing without significant interference or cross-hybridization, and (5) sample processing methodologies that allow the resequencing array to be used in conjunction with minimally-biased nucleic acid amplification strategies on complex clinical samples.

The combination of these methods allows the simultaneous detection and identification of a high multiplicity of pathogen(s) from a clinical sample by a single qualified technician within a period of 24 hours, but preferably within 4 hours, more preferably with 2 hours, most preferably within 30 minutes.

Accordingly, owing to its embodiments, the present invention supports: (a) routine diagnosis of infection in a clinical setting within several hours of sample collection, (b) simultaneous interrogation of the sample for indications of a rare infectious event (e.g. unanticipated pathogen, antibiotic resistance pattern or biological warfare agent), (c) routine molecular pathogen surveillance, (d) vaccine quality control and (e) monitoring of genetic changes of a pathogen as a result of natural genetic variations, drug treatment, intentional manipulation, or other events.

High-Density Resequencing Microarrays

High-density microarrays (HDMs) are fabricated by light-directed combinatorial synthesis of DNA oligomers (Kozal et al., 1996). The DNA oligomers synthesized on these sites typically have lengths of 20-30 bases. Through subsequent improvements to the method using high-resolution semiconductor photoresists, Affymetrix has demonstrated fabrication of HDMs having individual features with resolutions approaching 1 $\mu m^2$, enabling probe feature densities of 10-100 times greater than that demonstrated in the RPMV1. To date, HDM designs relevant to pathogen identification have been based on a "tiling" strategy. Accordingly, four probes of equal length are synthesized for each base in both the sense and antisense directions, requiring that a total of eight 25-mer probes are used for each base pair in a given reference sequence. One probe in each direction (sense and antisense) exactly complements the reference sequence while three others have a single base mismatch at the position of the interrogated base. Thus, a tiled HDM can effectively allow the target nucleic acid to be "resequenced".

In this manner, the base calls of the unknown target are interrogated at each of one of four possible base positions (one of every four possible base pairings varied at the number 13 position in the tiled 25 mer probes), allowing a direct read of the target sequence from the corresponding positions across the array. In the case of CustomSeq arrays, the GCOS (Version 1.1) software is used to reduce the raw image (.DAT) file to a simplified file format (.CEL file) with intensities assigned to each of the corresponding probe positions. Finally, the GDAS (Version 2.0) software is used to apply an embedded version of the ABACUS (Cutler et al., 2001) algorithm to produce an estimate of the correct base calls, comparing the respective intensities for the sense and antisense probe sets. One of the available export file types from GDAS is the FASTA-formatted base calls made for each tiled region of the resequencing array.

HDMs of the type described above have been used to identify pathogen species and detect drug resistance-conferring mutations in a series of in vitro experiments using cultured microorganisms, including HIV (Kozal et al., 1996). Troesch et al. (Troesch et al., 1999) designed HDMs to discriminate between 54 different to detect *Mycobacterium* species and *Mycobacterium tuberculosis* rifampin resistance. A tiled array of 65,000 oligomer probes was used to accurately resequence 70 clinical isolates of 27 mycobacterial species and 15 rifampin-resistant *M. tuberculosis* strains. More recently, sequence-specific identification of *F. tularensis* and *Y. pestis* was demonstrated in environmental samples using tiled HDMs (Wilson et al., 2002b). Both of these general approaches rely on specific hybridization patterns based on ground-truth (control) measurements. Moreover, the authors have provided no direction on how a quantitative comparison might be made against closely-related or unanticipated organisms for starting concentrations that may vary by six orders of magnitude.

Array Types

The present invention is developed using Affymetrix CustomSeq resequencing microarrays. For a discussion of resequencing microarrays, the artisan is directed to U.S. Pat. No. 6,228,575, which is incorporated herein by reference in its entirety. However, the present invention is not conceptually limited to microarrays produced using that specific fabrication strategy. In principle, resequencing can be performed on the scale described with any technology that is capable of producing microarrays with sufficient feature density to allow this approach. Theoretically this can be accomplished using an oligonucleotide printing technology, but it is more likely accomplished using a photolithographic approach. Whereas the Affymetrix resequencing chips are based on sequential lithographic steps using a separate mask that corresponds to each step, an alternative approach could use maskless lithography (Albert et al., 2003; Nuwaysir et al., 2002) or by nanolithographic methods (Ginger, Zhang & Mirkin, 2004). More generally, any method of producing a plurality of oligonucleotide probes for the purpose of determining target sequence would be applicable, even bead "arrays" that are not in a 2-dimensional format (Ferguson et al., 2000).

The probes themselves could be comprised of variants of DNA, namely RNA or oligomeric peptide-nucleic acids (PNA). The probes can be made sensitive to enzyme digestion, then subject to subsequent handling. In a preferred embodiment, the probes will incorporate dUTP instead of dTTP, making them sensitive to uracil-DNA-glycosylase. This will make them amenable to selective degradation following the capture of target. Moreover, within the scope of the present invention it is also possible to immobilize RNA and obtain complementary sequence recognition thereof. Immobilization of RNA would require chemical stabilization of the RNA. In a more general sense, the probes can be made from chemically modified nucleic acids that would make them more or less susceptible to subsequent chemical processing steps.

Array Design

This present invention, using the RPMV1 microarray, illustrates the ability of tiled prototype sequences to identify a wide variety of specific pathogen strains without assuming that specific hybridization patterns are required for specific pathogen identification. In the current apparatus, the prototypes for tiled regions, particularly those for adenoviruses 4, 5, and 7, were empirically chosen to be representative of adenovirus subgroups E, C, and B, respectively.

A more preferred and systematic approach to the design would involve the use of multiple sequence alignments to produce consensus sequences, where consensus sequences are defined as those representing the most frequent bases at the alignment position. In a preferred embodiment, the alignment algorithm will produce a hierarchical phylogenetic tree for target gene sequences from individual pathogen strains or for a group or family of pathogens. A consensus sequence will first be formed for members of each node or group of nodes on the tree, whose distance measures fall within a threshold, using an appropriate algorithm (Lee, 2003). The actual target sequences would then be compared individually to the consensus sequence, and the effects of hybridization to a tiled microarray region defined by the consensus sequence would be simulated. Known effects such as insertion or deletion of bases, as well as the effects of multiple base substitutions within an oligonucleotide probe region would define rules for the simulated hybridization. Subsequent analysis of the resultant hybridization and base call pattern would then indicate the suitability of a proposed tile for acting as a prototype for a given range of pathogens. This process would be reiterated until the most suitable set of prototype regions were defined for coverage of a given set of pathogens. In one very preferred embodiment, this process would be used to maximize the efficiency of space usage on a chip, resulting in the greatest reduction in the overall physical dimensions of a resequencing microarray, and thus, the greatest reduction in manufacture cost per microarray.

In one preferred embodiment, the resequencing array would be designed in combination with another less complex solid phase capture device (array, gel, or otherwise) that that would be used initially to queue the resequencing array. For example, an array comprised of a multiplicity of long oligonucleotide probes would be used initially for the detection of pathogen by recognizing conserved sequences within a family of pathogens. The resequencing array could then be used to interrogate variable regions associated with the conserved probes on the initial array, providing detailed sequence information on the pathogen. In a very preferred embodiment, the sample preparation would be common for both the solid phase capture device and the resequencing microarray. In yet another very preferred embodiment, the initial array would be used to capture target that would be isolated and then amplified using non-biased amplification techniques for presentation to the resequencing array.

Overall Design Philosophy for the Intended Use

This invention leverages pathogen genome information from various public and/or private sources to design, fabricate, evaluate, validate and integrate an advanced diagnostics platform as part of an effective biodefense surveillance and operational medicine system. It is an integral facet of the Epidemic Outbreak Surveillance (EOS) program biodefense model that the system would most effectively be enabled through the adoption of a widely distributed device that would find utility in routine diagnostics of infectious diseases, most particularly in diagnosis of infectious respiratory disease (see the Defense Sciences Board Summer 2000 Study Report and the Health Sciences Biodefense System (HSBS) final briefing). It is important that the device (e.g. microarray) will provide a cost-effective alternative to conventional approaches to the diagnosis, management, and surveillance of infectious diseases, most particularly respiratory infections. It is equally important that the device is supported with design and analysis informatics, and to ensure that decision quality information from that device will be transmissible and interpretable by a variety of care providers, public health officials, and decision makers. Thus, it is a critical objective of this invention that the device (e.g. microarray) be a key component of an integrated system comprised of a local point-of-care diagnostic device that provides automated, two-way data sharing between health care providers, public health officials, and decision makers (this a maybe a cross-reference to the business model patent that is in the queue). The invention described herein might fulfill this role in at least two ways: (1) through reduction in array size (i.e. lower cost), process automation, and the availability of portable hardware for processing resequencing arrays, the invention could become the object of the point-of-care device itself, and (2) in the event of lower-cost or easily automated microarray alternatives, the resequencing array can be a higher echelon component in a diagnostics/surveillance pipeline. In the latter case, the lower-cost alternative device will provide for initial sample processing, pathogen target enrichment, amplification, decision information at the point-of-care, while the resequencing capability provides for a sequential testing capability by facilitating a more detailed interrogation of the sample when desired.

General Strategy for Resequencing Microarray Chip Design

According to the present invention, the process of designing resequencing microarray chips is carried out by selecting pathogen genomic sequences having sequence properties that make them unique to a small number (ideally one) of pathogens, or are highly conserved, allowing them to detect many types of microbial species at the family or genus level, or are moderately conserved and selected as "prototype" regions. Prototype regions will have an intermediate level of sequence homology across a group of microbial species and allow for both efficient hybridization and unique identification of most or all of a subtype of pathogenic species. The design strategy for layout of resequencing tiles includes leveraging from alignment of similar sequences and application of a consensus probe sequence for tiling to the chip. The consensus sequence might not be identical to any of selected pathogens, but will interact with a plurality of similar pathogen genomes. The patterns of perfect and imperfect matching of real pathogen genome sequences with the consensus sequence will provide diagnostic discrimination power.

In a particular embodiment of the present invention is a general protocol for designing resequencing microarray chips that permit the identification and designation of pathogens present in a sample (e.g., a partially purified sample, a purified sample, an enriched sample, a biological sample, etc.). The various aspects of this design and validation protocol are embodied in the following 6 "phases."

Phase 1: Pathogen Identification:
   a. Pathogen list (e.g. Adenovirus; Influenza; *Streptococcus pyogenes*)—provided by pathogen experts or public domain
   b. Genus/species (new pathogen i.e. Severe acute respiratory syndrome (SARS) variant of corona virus)
   c. Species/subspecies (Epidemiologic tracking; forensics)
   d. Pathogen unique segments (cross hybridization issues)
   e. Issues of genetic shift/drift (e.g. Influenza, HIV)
   f. Drug resistance markers
   g. Pathogenicity-related genes or virulence markers (useful for diagnostic and prognostic purposes)
   h. Markers for genetically engineered traits
   i. Plasmid DNA sequence (Bluescript, PUC etc.)
      i. Multiple cloning sites
      ii. Drug resistance markers (ampicillin, kanamycin, penicillin etc.) (or could list as: Amp, Kan, PBP, etc.)
      iii. Toxins (botulinum; ricin etc)

Phase 2: Pathogen identification in relation to sample sources:
   a. Common respiratory pathogens (and close relatives)
   b. Biothreat agents: (identified by Centers for Disease Control)
   c. Consideration of background or commensal organisms in:
      i. Clinical samples (nasal wash, swab, stool, etc.)
      ii. Vectors (e.g. mosquito)
      iii. Environment (water, food, soil)

Phase 3: Gene Identification: (Most complicated issue associated with pathogen design)
   a. Sequence Homology (relative to pathogen identity)
      a. Highly conserved (Genus/Species identification) Identification of novel or unanticipated)
         i. Identify new/unanticipated organisms
            1. chimeras (bacterial genetic exchange)
            2. genetic shift/drift variants (i.e. Influenza)
            3. man-made
         ii. Distinguish complicated pathogen families
            1. Rhinovirus (many disparate variants)
      b. Less conserved to hypervariable (Species/subspecies)
      c. Pathogen-unique sequence segments (cross hybridization)
         i. Potentially important for a total amplification approach
   b. Functional Sequences (relative to pathogenicity and patient management)
      a. Drug Resistance genes in commensal microbes
      b. Pathogenicity related genes
         i. Toxin genes
         ii. Transmission (Infectivity) related genes
         iii. Pathogenicity islands
         iv. Virulence factors
      c. Other Host-pathogen interacting genes
         i. Immune response
         ii. Tumorogenesis
         iii. DNA repair Phase 4: Gene Selection (What sequences should actually be placed on the chip)
- a. Identify Gene Accession Number(s)
  - a. Complete gene
  - b. Pathogen genome for flanking sequences (Controls)
  - c. Most recent/prevalent variants available
    - i. Especially important for rapidly evolving pathogens (Influenza)
- b. BLAST search: (Inclusion/Exclusion criteria)
  - a. Human sequence homology (exclusion criteria)
  - b. Related pathogen sequences
    - i. Possible exclusion/annotation criteria
    - ii. If >90% homology, sequence needs only to be deposited once
      - 1. Use consensus sequence for identity and annotate as such
    - iii. Identify pathogen specific genes/sequences
- c. Pragmatic Issues
  - a. Horizontal gene transfer issues in bacteria
  - b. Number of copies of gene in pathogen
  - c. Sequence homology with human sequence (cross hybridization)
  - d. Sequence homology with less pathogenic species (i.e. *Bacillus*; variola [pox])

Phase 5: RPM chip prioritization
- a. Define chip "real estate" (total sequences represented)
  - a. Target gene tile sizes
    - i. Associate accession numbers with tiles
    - ii. Associate accession numbers with consensus sequences
- b. Refer to primary objectives for prioritization criteria. Key issue include:
  - a. Prevalence of pathogen depending on targeted population, geographic location, season, and other disease transmission factors
  - b. Clinical, operational, and public health relevance
  - c. Chip functionality issues:
    - i. Mixed pathogens
    - ii. Data annotation and presentation to end-user Phase 6. Microarray Validation:
- a. Design controls
  - a. Nested primers sets:
    - i. Outer primer set: Develop controls
    - ii. Inner primer set. Assay positive control
    - iii. Control and RPM sequence should be 100% sequence match
  - b. Control clones developed
  - c. Control clones sequence validated for match.
- b. Develop pathogen chip annotation schema:
  - a. Sites of poor hybridization
    - i. Poor signal
    - ii. Incorrect signal
  - b. Sites of cross hybridization
    - i. Human cross hybridization
    - ii. Other pathogens (especially bioterrorism agents and toxins)
  - c. Level of specificity of sequence
    - i. Markers that can identify subspecies/variants
      - 1. Forms the basis of a forensics database
    - ii. Markers that can identify genus or species only
    - iii. Identification of new variant markers as discovered
  - c. Chip Validation Experimental Framework:
    - a. Human hybridization to detect cross hybridization regions
    - b. Plasmid-based validation schema:
      - i. Titrate plasmid for PCR sensitivity
      - ii. Titrate for RPM detection sensitivity
      - iii. Estimate base-calling accuracy with varied concentrations
        - 1. Annotate any errors
    - c. Culture-based validation schema
      - i. Titration of virus
        - 1. Efficiency of nucleic acid isolation
        - 2. Chip hybridization sensitivity/specificity
          - a. Total amplification sensitivity/specificity
          - b. PCR comparison
        - 3. Chip hybridization sensitivity from titrated culture
        - 4. Sequence validation of culture sequence
    - d. Spiked pathogens into complex media
      - i. Titration of virus into solution
      - ii. Hybridization to chip (background interference)
      - iii. Sequence validation of virus if different than culture pathogen
    - e. Estimation of target concentration from complex matrices.
      - i. Nasal wash
      - ii. Cotton swab
        - 1. Nasal swab
        - 2. Throat swab
      - iii. Stabilization of virus in solution
        - 1. Nasal wash
        - 2. Swabs
      - iv. Freeze/thaw effects of virus solution
      - v. Sequence validation of target pathogen The following table (Table 1) represents a preferred (but not limiting) set of pathogens (both viral and bacterial) that may be used within the context of the present invention as designed for the detection and diagnosis of common respiratory pathogens:

TABLE 1

| Microarray Pathogens | |
| --- | --- |
| Viral Pathogens | Bacterial Pathogens |
| Adenovirus (Serotypes/Genus level) | *Streptococcus pyogenes* (cmm types/resistance) |
| Influenza A and B (strains) | *Mycoplasma pneumoniae* |
| Coronavirus/SARS | *Bordetella pertussis* |
| Parainfluenza 1, 2, 3, 4 | *Chlamydia pneumoniae* |
| Respiratory Syncitial Virus | *Streptococcus pneumoniae* |
| Metapneumovirus | *Legionella* (genus level) |
| Rhinoviruses | *Moraxella catarrhalis* |
| Coxsackie virus | *Haemophilus influenza* |
| Echoviruses | *Neisseria meningitidis* |
| West Nile Virus | *Mycobacterium tuberculosis* |
| Varicella (HHV-3) | *Staphylococcus aureus* |
| Hantaviruses | *Arcanobacterium hemolyticum* |
| Rubella, Rubeola | *Chlamydia psittaci* |
| Herpes simplex types 1 and 2 | |
| Enteroviruses (mumps, polio) | |
| Parvovirus | |

For the intended use of a broadly distributed respiratory diagnostic device with built-in surveillance capability for agents of bioterrorism, the list of pathogens chosen for inclusion onto the chip would also include those selected from the U.S. Centers for Disease Control (CDC) Category A, B, and C bioterrorism agents. These are most notably, but not limited to, include:

CDC Category A
Bacillus anthracis (targets: lethal factor, protective antigen)
Yersinia pestis
Smallpox (variola major)
Francisella tulrensis
Viral hemorrhagic fevers (filoviruses [e.g. Ebola, Marburg] and arenaviruses [e.g. Lassa, Machupo]
CDC Category B
Brucella abortus (2308 B37), Brucella melitensis (F6145), Brucella suis (A44)
Burkholderia mallei (Glanders)
Burkholderia pseudomallei (Meliodosis)
Psittacosis (Chlamydia psittaci)
Typhus fever (Rickettsia prowazekii)
Viral encephalitis (alphaviruses [e.g., Venezuelan equine encephalitis, eastern equine encephalitis, western equine encephalitis])
CDC Category C
Emerging infectious diseases such as Nipah virus and hantavirus
A complete and updated listing of these agents may be found on the CDC website (http://www.cdc.gov/).

For purposes of illustration of the present invention, two resequencing microarray chips (RPMV1 and RPMV2) will be described herein below:

Resequencing Respiratory Pathogen Microarray Version 1 (RPMV1 Chip)

RPMV1 was made using a high-density Affymetrix microarray fabrication process having an individual probe feature size of 18×18 microns. At this density, 29.7 kb of total pathogen target sequence was tiled for resequencing. The fabrication was performed as part of a pre-production beta-test of an Affymetrix commercial product (CustomSeq) that was intended for SNP detection in an arbitrary collection of sequences.

The following overall design strategy was used for the RPMV1:

The Affymetrix CustomSeq design protocol was followed. While there were a variety of ongoing efforts within the project consortium to non-specifically amplify targets for microarray analysis, the present inventors made every effort to tile sequences on the array that could interrogate conventional (specific primer pair) PCR amplicons. Whenever possible, primer pairs were developed or adapted for conserved sequences that flanked the variable regions to be interrogated with tiled microarray probe sets. This allowed for the ability to: (1) directly amplify with an existing hardware platform (e.g. RAPID Light Cycler, Idaho Technologies), (2) provide control measurements for comparison with generic or total amplification strategies that are on the immediate horizon. In general, our strategy was to match the hybridization patterns with specific strains of organisms and to detect subtle variations in sequence that corresponds to pathogenicity and drug resistance.

Adenovirus (double-stranded DNA virus) types 4, 5, and 7 were designated as "prototypes" for the E, C and B subgroups, respectively. Specifically, the present inventors postulated that resequencing on the prototype-tiled regions would allow detection and identification of subtle sequence variations between the subgroup members. Three target gene regions were selected, specifically from E1A, hexon, and fiber genes. However, it was not postulated nor anticipated which regions or which sections of any of the tiles would allow unique identification.

Thirteen adenovirus genomes were completely sequenced as part of the Epidemic Outbreak Surveillance program. The names, accession numbers, and sources for these are listed in Table 6 of the Examples section. Multiple sequence alignments were performed to determine variable regions of the E1A, hexon, and fiber genes that were flanked by conserved regions that could be used to amplify multiple adenoviruses with a single set of degenerate primers (Lin et al., 2004). These common regions for E1A, hexon, and fiber genes were obtained for each of the 3 prototype adenoviruses that are associated with respiratory illness: 7 (subgroup B), 5 (subgroup C), and 4 (subgroup E) were submitted to Affymetrix as part of the 29.7 kb total pathogen target sequence for tiling on the RPMV1 microarray.

Adenovirus Taxonomy:
Sub-Group B: 3, 7, 11, 14, 21, 34, 35 and 50
Sub-Group C: 1, 2, 5, and 6
Sub-Group E: 4

The present inventors made the hypothesis that if they tiled three genes (E1A, Fiber and Hexon) on the array for prototype sub-group representatives, types 7, 5, and 4 (for subgroups B, C, and E, respectively), they would be able to identify any of the fully-sequenced types (listed above) by variations in the hybridization patterns that map to their sequence differences.

Influenza A and B viruses, which are negative-polarity single stranded RNA viruses (ssRNA), were represented with prototype regions for hemagglutinin (HA) neuraminidase (NA) and matrix (M). These genes were represented for three types of Influenza A (H1N1, H3N2 and H5N1) and Influenza B. Influenza is one of the best examples of a prototype model system, as hundreds, if not thousands of influenza strains have been at least partially sequenced, and most have been sequenced for the hemagglutinin and neuraminidase segments.

Prototype Influenza HA, NA and M genes were chosen from strains that were either identical of closely related to the three vaccine strains recommended for the Northern hemisphere by the World Health Organization;
A/New Caledonia/20/99/(H1N1)
A/Moscow/10/99/(H3N2)
B/Hong Kong/330/2001

These sequences were publicly available from the Los Alamos National Laboratory influenza Internet database. The present inventors postulated that the sequence calls made for unknown Influenza A or B on the prototype tile regions would allow the identification of that target if it was sufficiently similar to allow similarity search-based querying.

The remainder of RPMV1 was populated with tiles for a variety of common respiratory pathogens, the first set being viruses:
Rhinovirus A (pos)SSRNA
Rhinovirus B (pos)SSRNA
Coronavirus (pos)SSRNA; no DNA stage
Parainfluenza (neg)SSRNA
RSV (neg)SSRNA These viral pathogens had relatively little sequence available compared to adenovirus and influenza, complicating efforts to perform analogous tests for use of prototype sequences to identify a large number of related strains.

Common bacterial pathogens were also chosen:
Streptococcus pyogenes
Mycoplasma pneumoniae
Bordetella pertussis
Chlamydia pneumoniae
Streptococcus pneumoniae
Neisseria meningitidis In addition, the following plasmid-conferred antibiotic resistance genes were represented on the RPMV1 chip:
ermA
ermB
ermTR
macrolide-efflux determinant (mef)A The following biological threat agents were also included on the RPMV1 chip:
Bacillus anthracis (targets: lethal factor, protective antigen)
Yersinia pestis
Smallpox (variola major)
Francisella tularensis*

Viral hemorrhagic fevers (filoviruses [e.g. Ebola, Marburg] and arenaviruses [e.g. Lassa, Machupo])

In addition to the hybridization controls prescribed by Affymetrix (see CustomSeq protocol), it was considered necessary to include internal process controls to verify target isolation, reverse transcription (RT) and cDNA/DNA amplification. Thus, we included a specialized vector containing gene inserts from the plant *Arabidopsis thaliana* (Yang et al., 2002) and provided tile regions on the array for several genes inserts from that vector.

For all targets other than adenovirus and influenza, the present inventors selected targets from the open literature (e.g., NCBI GenBank) for genes containing diagnostic (via PCR) regions and tiled that diagnostic region or a larger coding region containing that region. The full listing of all target genes, PCR primer sites, and primers for the RPMV1 are shown in Table 8 (infra) and the attached Sequence Listing. The sequences submitted for tiling and chip fabrication are summarized in Table 7 (infra) and the attached Sequence Listing.

However, the present invention is not limited to the specific sequences and/or microorganisms (bacteria or virus) listed above. It is well within the purview of the skilled artisan to tailor the "pathogen chip" to meet the particular requirements of the intended field test. Such tailoring may be on a gene-level or on a microorganism level. Clearly, the artisan would be greatly assisted in the efforts by the general protocol above.

Resequencing Microarray Chip Version 2 (RPMV2 Chip)

RPMV2 is built on a high-density Affymetrix microarray having an intended feature size of 8×8 microns. At this density, approximately 300 kb of target sequence information may be tiled for resequencing.

The general layout strategy described in Tables 2-4 (infra). The RPM V2 design allowed for roughly 10 times the sequence content of the RPMV1, and thus allowed inclusion of a large number of pathogens, which included expanded representations of all the pathogens present on the RPMV1, numerous other respiratory pathogens, and virtually the entire set of CDC Category A, B, and C bioterrorism agents. The full listing of the RPMV2 content is provided in Example 8. The RPMV2 design expanded molecular epidemiology capability by enabling inclusion of probes, such as the emm types for *Streptococcus pyogenes*. This feature will provide the epidemiologist/public health professional an ability to determine a likely index disease case and to study transmission of the typed pathogen in enclosed populations (jails, dormitories, nursing homes, military barracks, etc.). These probes may also predict pathogen virulence and clinical presentation of disease in the population.

The number of pathogens represented can also be expanded with increasing probes per unit area of microarray. The chips of the present invention take advantage of high feature density to simultaneously probe and discriminate among a large number of candidate pathogens that may be present in a single clinical specimen.

It is also important to note that gene expression markers can conceptually be tiled onto the array in the same manner as genomic markers. Thus, sequences representing pathogen transcripts (RNA templates coding for protein synthesis) can be simultaneously positioned on arrays with those allowing resequencing of genomic markers. This would enable the microarray to detect not only the presence of a pathogen, but would also allow determination of viability, since transcriptional markers would only be present in intact pathogens.

TABLE 2

| RPMV2 layout (Name) | | | | | |
|---|---|---|---|---|---|
| Respiratory Pathogen Name | Species/Sub-species | Species/Sub-species | Species/Sub-species | Genus/Species | Rx Res |
| BT Agent Name (CDC A; B; C) Adenovirus | | | | | |
| Subgroup A | Hexon | Fiber | | E1A | |
| Subgroup B1 | | | | | |
| Adenovirus 3 | Hexon | Fiber | | E1A | |
| Adenovirus 7 | Hexon | Fiber | | E1A | |
| Adenovirus 16 | Hexon | Fiber | | E1A | |
| Adenovirus 21 | Hexon | Fiber | | E1A | |
| Subgroup B2 | | | | | |
| Adenovirus 11 | Hexon | Fiber | | E1A | |
| Adenovirus 35 | Hexon | Fiber | | E1A | |
| Subgroup C | | | | | |
| Adenovirus 1 | Hexon | Fiber | | E1A | |
| Adenovirus 2 | Hexon | Fiber | | E1A | |

TABLE 2-continued RPMV2 layout (Name)

| Respiratory Pathogen Name | Species/Sub-species | Species/Sub-species | Species/Sub-species | | | Genus/Species | Rx Res |
|---|---|---|---|---|---|---|---|
| Adenovirus 5 | Hexon | Fiber | | | | E1A | |
| Adenovirus 6 | Hexon | Fiber | | | | E1A | |
| Subgroup D | | | | | | | |
| Subgroup E | | | | | | | |
| Adenovirus 4 | Hexon | Fiber | | | | E1A | |
| Subgroup F | Hexon | Fiber | | | | E1A | |
| Influenza | | | | | | | |
| Influenza A | Hemagglutinin 1 (Full) | Neuraminidase 1 (Full) | Neuraminidase 1 (H5N1) | | | Matrix | |
| | Hemagglutinin 2 | Neuraminidase 2 (Full) | | | | | |
| | Hemagglutinin 3 (Full) | Neuraminidase 3 | | | | | |
| | Hemagglutinin 4 | Neuraminidase 4 | | | | | |
| | Hemagglutinin 5 | Neuraminidase 5 | | | | | |
| | Hemagglutinin 6 | Neuraminidase 6 | | | | | |
| | Hemagglutinin 7 | Neuraminidase 7 | | | | | |
| | Hemagglutinin 8 | Neuraminidase 8 | | | | | |
| | Hemagglutinin 9 | Neuraminidase 9 | | | | | |
| | Hemagglutinin 10 | | | | | | |
| | Hemagglutinin 11 | | | | | | |
| | Hemagglutinin 12 | | | | | | |
| | Hemagglutinin 13 | | | | | | |
| | Hemagglutinin 14 | | | | | | |
| | Hemagglutinin 15 | | | | | | |
| Influenza B | Hemagglutinin B | Neuraminidase B | | | | Matrix | |
| Influenza C | Hemagglutinin-esterase | | | | | Matrix | |
| Parainfluenza | | | | | | | |
| Parainfluenza 1 | Hemagglutinin-neuraminidase | | | | | Matrix | |
| Parainfluenza 2 | Hemagglutinin-neuraminidase | | | | | Matrix | |
| Parainfluenza 3 | Hemagglutinin-neuraminidase | | | | | Matrix | |
| Parainfluenza 4A | Hemagglutinin-neuraminidase | | | | | Matrix | |
| Rhinovirus | 5' NCR HRV 9501468 | 5' NCR HRV21 | 5' NCR HRV29 | 5' NCR HRV 9501821 | 5' NCR HRV62 | | |
| | 5' NCR HRV1A | 5' NCR HRV58 | 5' NCR HRV14 | 5' NCR HRV87 | | | |
| Coronavirus | | | | | | | |
| SARS | Membrane Glycoprotein | Nucleocapsid | Spike | | | Matrix | |
| O43 | Hemagglutinin-esterase | Nucleocapsid | Spike | | | | |
| 229E | Surface Glycoprotein | Nucleocapsid | Spike | | | | |
| Respiratory Syncitial Virus | | | | | | | |
| Type 1 (RSV A) | Nucleocapsid | | | | | Matrix | |
| Type 2 (RSV B) | Nucleocapsid | | | | | Matrix | |
| *Streptococcus* | | | | | | | |
| *Streptococcus pyogenes* | emm 1 | ST2035 | ST4529L | ST4532 | ST4264 | ST4547 | GyrA | Erm(A); Erm (B); Erm (TR); MefA; MefE; prtF1; |

TABLE 2-continued

RPMV2 layout (Name)

| Respiratory Pathogen Name | Species/Sub-species | Species/Sub-species | Species/Sub-species | | | Genus/Species | Rx Res |
|---|---|---|---|---|---|---|---|
| | | | | | | | put. Rx resist prot.; tet(O) |
| | emm 75 | emm13L | ST3018 | U92492 | STI4973 | STCMUK16 | |
| | | ST2267 | U50338 | ST2980 | ST230-2 | ST436 | |
| | | ST448L | ST3365 | ST1135 | ST1161 | ST1432 | |
| | | ST6949 | ST1160 | | | | |
| | | emm1 | emm2 | emm3 | emm4 | emm5 | |
| | | emm6 | emm7 | emm8 | emm9 | emm10 | |
| | | emm11 | emm12 | emm13 | emm14 | emm15 | |
| | | emm16 | emm17 | emm18 | emm19 | emm20 | |
| | | emm21 | emm22 | emm23 | emm24 | emm25 | |
| | | emm26 | emm27 | emm28 | emm29 | emm30 | |
| | | emm31 | emm32 | emm33 | emm34 | emm35 | |
| | | emm36 | emm37 | emm38 | emm39 | emm40 | |
| | | emm41 | emm42 | emm43 | emm44 | emm45 | |
| | | emm46 | emm47 | emm48 | emm49 | emm50 | |
| | | emm51 | emm52 | emm53 | emm54 | emm55 | |
| | | emm56 | emm57 | emm58 | emm59 | emm60 | |
| | | emm61 | emm62 | emm63 | emm64 | emm65 | |
| | | emm66 | emm67 | emm68 | emm69 | emm70 | |
| | | emm71 | emm72 | emm73 | emm74 | emm75 | |
| | | emm76 | emm77 | emm78 | emm79 | emm80 | |
| | | emm81 | emm82 | emm83 | emm84 | emm85 | |
| | | emm86 | emm87 | emm88 | emm89 | emm90 | |
| | | emm91 | emm92 | emm93 | emm94 | emm95 | |
| | | emm96 | emm97 | emm98 | emm99 | emm100 | |
| | | emm101 | emm102 | emm103 | emm104 | emm105 | |
| | | emm106 | emm107 | emm108 | emm109 | emm110 | |
| | | U74320 | | | | | |
| | | Csr R & Csr S | sic | SpeB | | | |
| *Streptococcus pneumoniae* | ponA (Pbp1A) | | | | | GyrA | GyrB; ParC |
| *Staphylococcus aureus* | entQ | entK | tst | seb | | GyrA | MSR(A); mecR1; VanA; BlaZ; dfrA; qacC |
| *Mycoplasma pneumoniae* | P1 gene | | | | | GyrA | |
| *Bordetella pertussis* | Pertussis toxin | PrnA | | | | | |
| *Chlamydia* | | | | | | | |
| *Chlamydia pneumoniae* | OmpB | | | | | DNA Gyrase | |
| *Chlamydia psittaci* | OmpA | SigA | | | | | |
| *Neisseria meningitidis* | MviN | | | | | GyrA | |
| *Bacillus* | | | | | | | |
| *Bacillus anthracis* | protective antigen | rpoB | lethal factor | adema factor (Cya) | | GyrA | |
| *Bacillus cereus* | | rpoB | | | | | |
| *Bacillus thuringensis* | cry | rpoB | | | | | |
| *Bacillus subtillus* | | rpoB | | | | | |
| | | rpoB | | | | | |
| *Yersinia pestis* | OmpA | cve2155 sequence | | | | GyrA | |
| Smallpox (variola major) | Hemagglutinin | SOD | | | | Chemo kine binding protein | |
| Monkeypox | Hemagglutinin | IA | | | | | |
| Varicella | Hemagglutinin | | | | | | |
| *Francisella tularensis* | TUL4 | Region of Difference (RD1) | | | | mdh | |
| Filoviridae | | | | | | | |
| Ebola | L gene | NP Protein | | | | | |
| Marburg | L gene | NP Protein | | | | | |

TABLE 2-continued

RPMV2 layout (Name)

| Respiratory Pathogen Name | Species/Sub-species | Species/Sub-species | Species/Sub-species | Genus/Species | Rx Res |
|---|---|---|---|---|---|
| Arenaviridae | | | | | |
| Lassa | L protein | NP Protein | | | |
| Machupo | L protein | NP Protein | | | |
| Burkholderia | | | | | |
| Burkholderia mallei (Glanders) | PenA | | | WaaF | |
| Burkholderia pseudomallei (Meliodosis) | PenA | | | WaaF | |
| Burkholderia cepacia | recA | | | | |
| Typhus fever (Rickettsia prowazekii) | Omp1 | | | GyrA | ermB |
| Alphaviruses | | | | | |
| Venezuelan equine encephalitis | nonstructural polyprotein | nucleocapsid proteins | | | |
| Eastern equine encephalitis | nonstructural polyprotein | nucleocapsid proteins | | | |
| Western equine encephalitis | nonstructural polyprotein | nucleocapsid proteins | | | |
| Brucella | Omp25 | Omp2 | RB51_WBOA_IS711J INSERT | | |
| Brucella abortus (2308 B37) | | | | | |
| Brucella melitensis (F6145) | | | | | |
| Brucella suis (A44) | | | | GyrA | |
| Brucella canis | | | | | |
| Brucella ovis | | | | | |
| Brucella neotoma | | | | | |
| Arcanobacterium hemolyticum | 16S rRNA | pld | | | |
| Haemophilus influenzae | OmpP5 (OmpA-family) | | | GyrA | |
| Moraxella catarrhalis | hemagglutinin | | | GyrA | |
| Mycobacterium tuberculosis | Omp A | | | GyrA | |
| Clostridium | | | | | |
| Clostridium botulinum | Ntnh | Bont | | | |
| Clostridium perfringens | TmpC | Epsilon Toxin | | GyrA | |
| Clostridium tetani | L & H chain | | | | |
| Coxiella burnetii | TolC | | | GyrA | |
| Cryptosporidium parvum | Sod | CP2 | | | |
| E. coli 0157:H7 | Omp A | Shiga Toxin I | Shiga Toxin II | GyrA | |
| Ricinus communis | Ricinus communis toxin | | | | |
| Salmonella | | | | | |
| Salmonella enterica | OmpA | | | GyrA | |
| Salmonella typhimurium | OmpA precursor | | | | |
| Shigella | | | | | |
| Shigella dysenteriae | OmpA | | | | |
| Shigella flexneri | OmpA | | | GyrA | |
| Vibrio cholerae | OmpA | CtxA & CtxB | | GyrA | |
| Nipah virus | Nucleocapsid | | | Matrix | |
| Hantavirus | | | | | |
| Sin Nombre | Nucleocapsid | Glycoprotein | | | |
| Legionella pneumophilia | MompS | | | GyrA | |

TABLE 2-continued

RPMV2 layout (Name)

| Respiratory Pathogen Name | Species/Sub-species | Species/Sub-species | Species/Sub-species | Genus/Species | Rx Res |
|---|---|---|---|---|---|
| *Histoplasma capsulatum* | M antigen | H antigen | | | |
| *Blastomyces dermatiditis* | WI-1 | bys1 | | | |
| *Coccidioides immitis* | bg12 | Ag2 | | | |
| Varicella | | | | | |
| Varicella HHV-6 | major capsid protein | Major antigenic structural protein | | | |
| Varicella HHV-3 | major capsid protein | immedi

TABLE 3

| RPMV2 layout (Accession Number) | | | | | | | |
|---|---|---|---|---|---|---|---|
| Respiratory Pathogen Name | Species/Sub-species | Species/Sub-species | Species/Sub-species | Species/Sub-species | Species/Sub-species | Genus/Species | Rx Res |
| BT Agent Name (CDC A; B; C) | | | | | | | |
| Adenovirus | | | | | | | |
| Subgroup A | NC_001460 | NC_001460 | | | | NC_001460 | |
| Subgroup B1 | | | | | | | |
| Adenovirus 3 | AF542129 | AY224415 | | | | AF492352 | |
| Adenovirus 7 | X76551 | Z48954 | | | | AY495969 | |
| Adenovirus 16 | X74662 | U06106 | | | | | |
| Adenovirus 21 | AB053166 | U06107 | | | | AF492353 | |
| Subgroup B2 | | | | | | | |
| Adenovirus 11 | AF532578 | L08232 | | | | BK001453 | |
| Adenovirus 35 | AB052912 | AB098563 | | | | AY128640 | |
| Subgroup C | | | | | | | |
| Adenovirus 1 | AF534906 | AB108423 | | | | AF534906 | |
| Adenovirus 2 | AY224391 | AY224410 | | | | BK001407 | |
| Adenovirus 5 | AF542130 | AY224411 | | | | AY147066 | |
| Adenovirus 6 | X67710 | AB108424 | | | | E1A | |
| Subgroup D | NC_002067 | NC_002067 | | | | NC_002067 | |
| Subgroup E | | | | | | | |
| Adenovirus 4 | X84646 | X76547 | | | | E1A | |
| Subgroup F | NC_001454 | NC_001454 | | | | NC_001454 | |
| Influenza | Crieria: Human; Swine; Avian (Newest 1st) | | | | | | |
| Influenza A | AJ344014 (vaccine) | AJ518092 | AY526746 | | | AJ458301 | |
| | L11125 | U42776 | | | | | |
| | ISDN38157 (vaccine) | AY300947 | | | | | |
| | ISDN13277 (vaccine) | K01030 | | | | | |
| | AF285885 | | | | | | |
| | AY526745 | M24740 | | | | | |
| | AJ507203 | AF285887 | | | | | |
| | AY338459 | AY340079 | | | | | |
| | AF310988 | AY300948 | | | | | |
| | AY294658 | AY180830 | | | | | |
| | AF311750 | | | | | | |
| | AF310986 | | | | | | |
| | AF310990 | | | | | | |
| | M26089 | | | | | | |
| | M35997 | | | | | | |
| | L43916 | | | | | | |
| Influenza B | AB126838 | AY139074 | | | | AB036877 | |
| Influenza C | AB093473 | | | | | AB086809 | |
| Parainfluenza | | | | | | | |
| Parainfluenza 1 | NC_003461 | | | | | NC_003461 | |
| Parainfluenza 2 | NC_003443 | | | | | NC_003443 | |
| Parainfluenza 3 | AY283063 | | | | | NC_001796 | |
| Parainfluenza 4A | E02727 | | | | | E03809 | |
| Rhinovirus | AF108164 | AF108180 | AF542420 | AF542420 | AF108184 | | |
| | AF108179 | AF108183 | AF108186 | AF108187 | | | |
| Coronavirus | | | | | | | |
| SARS | AY323974 | AY365036 | AY429079 | | | AY390556 | |
| OC43 | M76373 | NC_005147 | L14643 | | | | |
| 229E | NC_002645 | X51325 | X16816 | | | | |
| Respiratory Syncitial Virus | | | | | | | |
| Type 1 (RSV A) | AF035006 | | | | | AF035006 | |
| Type 2 (RSV B) | AF013254 | | | | | AF013254 | |
| *Streptococcus* | emm source | | | | | | |

TABLE 3-continued

| | | RPMV2 layout (Accession Number) | | | | | |
|---|---|---|---|---|---|---|---|
| Respiratory Pathogen Name | Species/Sub-species | Species/Sub-species | Species/Sub-species | Species/Sub-species | Species/Sub-species | Genus/Species | Rx Res |
| *Streptococcus pyogenes* | ST2035 | ST4529L | ST4532 | ST4264 | ST4547 | AE006557 | Erm(A); AY357120; Erm(TR); U70055; MefE; prtF1; AE006513 |
| | emm13L | ST3018 | U92492 | STI4973 | STCMUK16 | | |
| | ST2267 | U50338 | ST2980 | ST230-2 | ST436 | | |
| | ST448L | ST3365 | ST1135 | ST1161 | ST1432 | | |
| | ST6949 | ST1160 | | | | | |
| | emm1 | emm2 | emm3 | emm4 | emm5 | | |
| | emm6 | emm7 | emm8 | emm9 | emm10 | | |
| | emm11 | emm12 | emm13 | emm14 | emm15 | | |
| | emm16 | emm17 | emm18 | emm19 | emm20 | | |
| | emm21 | emm22 | emm23 | emm24 | emm25 | | |
| | emm26 | emm27 | emm28 | emm29 | emm30 | | |
| | emm31 | emm32 | emm33 | emm34 | emm35 | | |
| | emm36 | emm37 | emm38 | emm39 | emm40 | | |
| | emm41 | emm42 | emm43 | emm44 | emm45 | | |
| | emm46 | emm47 | emm48 | emm49 | emm50 | | |
| | emm51 | emm52 | emm53 | emm54 | emm55 | | |
| | emm56 | emm57 | emm58 | emm59 | emm60 | | |
| | emm61 | emm62 | emm63 | emm64 | emm65 | | |
| | emm66 | emm67 | emm68 | emm69 | emm70 | | |
| | emm71 | emm72 | emm73 | emm74 | emm75 | | |
| | emm76 | emm77 | emm78 | emm79 | emm80 | | |
| | emm81 | emm82 | emm83 | emm84 | emm85 | | |
| | emm86 | emm87 | emm88 | emm89 | emm90 | | |
| | emm91 | emm92 | emm93 | emm94 | emm95 | | |
| | emm96 | emm97 | emm98 | emm99 | emm100 | | |
| | emm101 | emm102 | emm103 | emm104 | emm105 | | |
| | emm106 | emm107 | emm108 | emm109 | emm110 | | |
| | U74320 | | | | | | |
| | U11966 | AF095713 | AY229859 | AB051298 | | | |
| *Streptococcus pneumoniae* | X67867 | | | | | AY157689 | GyrB; ParC |
| *Staphylococcus aureus* | U93688 | U93688 | U93688 | M11118 | | D10489 | AF467080; AF142100; AE017171 |
| *Mycoplasma pneumoniae* | AF290002 | | | | | X53555 | |
| *Bordetella pertussis* | M13223 | AJ507642 | | | | BX640413 (codon 286253) | |
| *Chlamydia* | | | | | | | |
| *Chlamydia pneumoniae* | X53511 | | | | | AB103388 | |
| *Chlamydia psittaci* | AF269281 | U04442 | | | | | |
| *Neisseria meningitidis* | AE002384 | | | | | AE002487 | |
| *Bacillus* | | | | | | | |
| *Bacillus anthracis* | AF306783 | AF205335 | M29081 | M24074 | | AY291534 | |
| *Bacillus cereus* | | AF205342 | | | | | |
| *Bacillus thuringensis* | AF278797 | AF205349 | | | | | |
| *Bacillus subtillus* | | AF205356 | | | | X02369 (orf 821) | |
| *Yerslnia pestis* | NC_003143 | AF350077 | | | | AE013898 | |
| Smallpox (variola major) | L22579 | L22579 | | | | L22579 | |
| Monkeypox | | | | | | | |
| Varicella | | | | | | | |
| *Francisella tularensis* | M32059 | A TABLE 3-continued

| | RPMV2 layout (Accession Number) | | | | | | |
|---|---|---|---|---|---|---|---|
| Respiratory Pathogen Name | Species/Sub-species | Species/Sub-species | Species/Sub-species | Species/Sub-species | Species/Sub-species | Genus/Species | Rx Res |
| Filoviridae | | | | | | | |
| Ebola | NC_004161 | NC_004161 | | | | | |
| Marburg | NC_001608 | NC_001608 | | | | | |
| Arenaviridae | | | | | | | |
| Lassa | NC_004297 | NC_004296 | | | | | |
| Machupo | NC_005079 | NC_005078 | | | | | |
| Burkholderia | | | | | | | |
| Burkholderia mallei (Glanders) | AY032868 | | | | | AY124769 | |
| Burkholderia pseudomallei (Meliodosis) | AY032869 | | | | | AF097748 | |
| Burkholderia cepacia | U70431 | | | | | | |
| Typhus fever (Rickettsia prowazekii) | AJ235270 | | | | | AJ235270 (codon 250672) | AJ235270 |
| Alphaviruses | | | | | | | |
| Venezuelan equine encephalitis | L04653 | L04653 | | | | | |
| Eastern equine encephalitis | NC003899 | NC003899 | | | | | |
| Western equine encephalitis | NC003908 | NC003908 | | | | | |
| Brucella | Consensus | Consensus | Consensus | | | | |
| Brucella abortus (2308 B37) | | | | | | | |
| Brucella melitensis (F6145) | | | | | | | |
| Brucella suis (A44) | | | | | | AE014411 | |
| Brucella canis | | | | | | | |
| Brucella ovis | | | | | | | |
| Brucella neotoma | | | | | | | |
| Arcanobacterium hemolyticum | X73952 | L16583 | | | | | |
| Haemophilus influenzae | L20309 | | | | | U32806 | |
| Moraxella catarrhalis | AY077637 | | | | | AF056196 | |
| Mycobacterium tuberculosis | BX842574 | | | | | AE006915 | |
| Clostridium | | | | | | | |
| Clostridium botulinum | Y13630 | X62683 | | | | | |
| Clostridium perfringens | AP003191 | X60694 | | | | AP003185 | |
| Clostridium tetani | X04436 | | | | | | |
| Coxiella burnetii | AE016960 | | | | | AE016960 | |
| Cryptosporidium parvum | AF529280 | AY471868 | | | | | |
| E. coli 0157:H7 | AE005582 | AB083044 | AB048837 | | | NC_002655 | |
| Ricinus communis | X52908 | | | | | | |
| Salmonella | | | | | | | |
| Salmonella enterica | AL627269 | | | | | AE016836 (codon 70224) | |
| Salmonella typhimurium | AE008746 | | | | | | |
| Shigella | | | | | | | |
| Shigella dysenteriae | V01344 | | | | | | |
| Shigella flexneri | AE015125 | | | | | AE016986 | |

TABLE 3-continued

| Respiratory Pathogen Name | Species/Sub-species | Species/Sub-species | Species/Sub-species | Species/Sub-species | Species/Sub-species | Genus/Species | Rx Res |
|---|---|---|---|---|---|---|---|
| Vibrio cholerae | AF030977 | Gary Custom | | | | NC_002505 | |
| Nipah virus | NC_002728 | | | | | NC_002728 | |
| Hantavirus | | | | | | | |
| Sin Nombre | NC_005216 | L33474 | | | | | |
| Legionella pneumophilia | AF078136 | | | | | AY091594 | |
| Histoplasma capsulatum | AF026268 | U20346 | | | | | |
| Blastomyces dermatiditis | S63772 | AF277079 | | | | | |
| Coccidioides immitis | AF022893 | U32518 | | | | | |
| Varicella | | | | | | | |
| Varicella HHV-6 | NC_001664 | NC_001664 | | | | | |
| Varicella HHV-3 | NC_001348 | NC_001348 | | | | | |
| Epstein-Barr Virus | NC_001345 | NC_001345 | | | | | |
| Corynebacterium | | | | | | | |
| Corynebacterium diphtheriae | A04646 | | | | | BX248354 | |
| Enterovirus (genus) | NC_001612 | | | | | | |
| Coxsackie (subgroup) | AF499635 | | | | | | |
| Echo (subgroup) | NC_003986 | | | | | | |
| Polio (subgroup) | NC_002058 | | | | | | |
| Paramyxoviridae | | | | | | | |
| Paramyxoviridae morbillivirus (Rubeola) | AY523581 | | | | | NC_001498 | |
| Newcastle | AY510092 | | | | | NC_002617 | |
| West Nile Virus | AF346319 | AF208017 | | | | | |
| Yellow Fever | AY359908 | AF013417 | | | | | |
| Metapneumovirus | AY145272 | | | | | AY145271 | |
| Norwalk Virus | NC_001959 | NC_001959 | | | | | |
| Dengue Virus | NC_001474 | NC_001474 | | | | | |
| Foot & Mouth | NC_004004 | NC_004004 | | | | | |
| St. Louis Encephalitis | AY289618 | AF013416 | | | | | |
| Rift Valley Fever | X53771 | X53771 | | | | | |
| Usutu | AF452643 | | | | | |

TABLE 4

| RPMV2 layout (Size) | | | | | | |
|---|---|---|---|---|---|---|
| Respiratory Pathogen Name | Species/Sub-species | Species/Sub-species | Species/Sub-species | | Genus/Species | Rx Res |
| BT Agent Name (CDC A; B; C) | | | | | | |
| Adenovirus | | | | | | |
| Subgroup A | 836 | 860 | | | 597 | |
| Subgroup B1 | | | | | | |
| Adenovirus 3 | 685 | 829 | | | 880 | |
| Adenovirus 7 | 605 | 829 | | | 880 | |
| Adenovirus 16 | 673 | 906 | | | | |
| Adenovirus 21 | 759 | 637 | | | 819 | |
| Subgroup B2 | | | | | | |
| Adenovirus 11 | 629 | 1025 | | | 789 | |
| Adenovirus 35 | 641 | 711 | | | 789 | |
| Subgroup C | | | | | | |
| Adenovirus 1 | 667 | 802 | | | 870 | |
| Adenovirus 2 | 789 | 698 | | | 870 | |
| Adenovirus 5 | 684 | 826 | | | 1055 | |
| Adenovirus 6 | 785 | 578 | | | | |
| Subgroup D | 644 | 783 | | | 579 | |
| Subgroup E | | | | | | |
| Adenovirus 4 | 2811 | 1375 | | | 616 | |
| Subgroup F | 828 | 659 | | | 909 | |
| Influenza | | | | | | |
| Influenza A | 1692 | 1459 | 575 | | 734 | |
| | 757 | 1410 | | | | |
| | 1042 | 804 | | | | |
| | 1323 | 257 | | | | |
| | 303 | 865 | | | | |
| | 839 | 691 | | | | |
| | 770 | 946 | | | | |
| | 849 | 795 | | | | |
| | 553 | 444 | | | | |
| | 727 | | | | | |
| | 680 | | | | | |
| | 690 | | | | | |
| | 813 | | | | | |
| | 715 | | | | | |
| | 745 | | | | | |
| Influenza B | 737 | 761 | | | 715 | |
| Influenza C | 401 | | | | 862 | |
| Parainfluenza | | | | | | |
| Parainfluenza 1 | 1649 | | | | 910 | |
| Parainfluenza 2 | 1646 | | | | 693 | |
| Parainfluenza 3 | 1581 | | | | 498 | |
| Parainfluenza 4A | 638 | | | | 807 | |
| Rhinovirus | 508 | 499 | 338 | 503 | 501 | |
| | 511 | 504 | 520 | 506 | | |
| Coronavirus | | | | | | |
| SARS | 666 | 1269 | 3768 | | 666 | |
| OC43 | 828 | 557 | 1042 | | | |
| 229E | 753 | 789 | 1393 | | | |
| Respiratory Syncitial Virus | | | | | | |
| Type 1 (RSV A) | 907 | | | | 958 | |
| Type 2 (RSV B) | 554 | | | | 826 | |
| *Streptococcus* | | | | | | |
| *Streptococcus pyogenes* | 675 | 425 | 713 | 661 | 340 | 815 | Erm(A); 763; 732; 563; MefE; prtF1 |
| | 200 | 316 | 371 | 415 | 680 | |
| | 413 | 384 | 401 | 688 | 350 | |
| | 355 | 554 | 619 | 475 | 664 | |
| | 650 | 635 | | | | |
| | 325 | 360 | 391 | 337 | 490 | |
| | 437 | emm7 | emm8 | 509 | emm10 | |

TABLE 4-continued

RPMV2 layout (Size)

| Respiratory Pathogen Name | Species/Sub-species | Species/Sub-species | Species/Sub-species | | | Genus/Species | Rx Res |
|---|---|---|---|---|---|---|---|
| | 500 | 364 | emm13 | 439 | 652 | | |
| | emm16 | 187 | emm18 | 381 | emm20 | | |
| | emm21 | 620 | 258 | 421 | 561 | | |
| | 936 | 317 | 333 | 328 | 265 | | |
| | 339 | 299 | 328 | 340 | emm35 | | |
| | 410 | 270 | 481 | 369 | 340 | | |
| | 488 | 408 | 306 | 391 | emm45 | | |
| | 315 | 331 | 489 | 485 | 287 | | |
| | 423 | 499 | 414 | 293 | 405 | | |
| | 389 | 338 | 391 | 433 | 452 | | |
| | 325 | 334 | 429 | 538 | 640 | | |
| | 528 | 335 | 526 | 566 | 440 | | |
| | 300 | 256 | 328 | 306 | 451 | | |
| | 353 | 450 | 415 | 322 | 354 | | |
| | 432 | 497 | 421 | 324 | 448 | | |
| | 404 | 420 | 346 | 379 | 483 | | |
| | 393 | 363 | 403 | 516 | 408 | | |
| | 358 | 357 | 351 | 372 | 340 | | |
| | 350 | 354 | emm103 | emm104 | emm105 | | |
| | emm106 | emm107 | emm108 | emm109 | emm110 | | |
| | 533 | | | | | | |
| | 292 | 904 | 1008 | 681 | | | |
| *Streptococcus pneumoniae* | 1237 | | | | | 815 | GyrB; ParC |
| *Staphylococcus aureus* | 771 | 729 | 705 | 713 | | 821 | 400; 652; 1032; 846; ##; ## |
| *Mycoplasma pneumoniae* | 2526 | | | | | 809 | |
| *Bordetella pertussis* | 824 | 730 | | | | 815 | |
| Chlamydia | | | | | | | |
| *Chlamydia pneumoniae* | 982 | | | | | 824 | |
| *Chlamydia psittaci* | 991 | 835 | | | | | |
| *Neisseria meningitidis* | 856 | | | | | 941 | |
| Bacillus | | | | | | | |
| *Bacillus anthracis* | 551 | 777 | 638 | 985 | | 732 | |
| *Bacillus cereus* | | 777 | | | | | |
| *Bacillus thuringensis* | 805 | 777 | | | | | |
| *Bacillus subtillus* | | 780 | | | | 812 | |
| *Bacillus globigii* | | | | | | | |
| *Yersinia pestis* | 913 | 517 | | | | 812 | |
| Small TABLE 4-continued

| RPMV2 layout (Size) | | | | |
|---|---|---|---|---|
| Respiratory Pathogen Name | Species/Sub-species | Species/Sub-species | Species/Sub-species | Genus/Species Rx Res |
| Western equine encephalitis | 878 | 902 | | |
| *Brucella* | 582 | 2428 | 1291 | |
| *Brucella abortus* (2308 B37) | | | | |
| *Brucella melitensis* (F6145) | | | | 995 |
| *Brucella suis* (A44) | | | | |
| *Brucella canis* | | | | |
| *Brucella ovis* | | | | |
| *Brucella neotoma* | | | | |
| *Arcanobacterium hemolyticum* | 1489 | 1111 | | |
| *Haemophilus influenzae* | 937 | | | 896 |
| *Moraxella catarrhalis* | 653 | | | 321 |
| *Mycobacterium tuberculosis* | 932 | | | 818 |
| *Clostridium* | | | | |
| *Clostridium botulinum* | 499 | 1000 | | |
| *Clostridium perfringens* | 1113 | 572 | | 810 |
| *Clostridium tetani* | 1138 | | | |
| *Coxiella burnetii* | 1851 | | | 812 |
| *Cryptosporidium parvum* | 375 | 2304 | | |
| *E. coli* 0157: H7 | 660 | 948 | 960 | 812 |
| *Ricinus communis* | 1133 | | | |
| *Salmonella* | | | | |
| *Salmonella enterica* | 904 | | | 812 |
| *Salmonella typhimurium* | 904 | | | |
| *Shigella* | | | | |
| *Shigella dysenteriae* | 907 | | | |
| *Shigella flexneri* | 898 | | | 812 |
| *Vibrio cholerae* | 942 | 984 | | 887 |
| Nipah virus | 858 | | | 1359 |
| Hantavirus | | | | |
| Sin Nombre | 639 | 1293 | | |
| *Legionella pneumophilla* | 1157 | | | 236 |
| *Histoplasma capsulatum* | 919 | 1082 | | |
| *Blastomyces dermatiditis* | 942 | 912 | | |
| *Coccidioides immitis* | 965 | 1234 | | |
| Varicella | | | | |
| Varicella HHV-6 | 890 | 1236 | | |
| Varicella HHV-3 | 822 | 781 | | |
| Epstein-Barr Virus | 971 | 1317 | | |
| *Corynebacterium* | | | | |
| *Corynebacterium diphtheriae* | 913 | | | 818 |
| Enterovirus (genus) | 1758 | | | |
| Coxsackie (subgroup) | 920 | | | |
| Echo (subgroup) | 1277 | | | |
| Polio (subgroup) | 1226 | | | |
| Paramyxoviridae | | | | |
| Paramyxoviridae morbillivirus (Rubeola) | 1854 | | | 1008 |
| Newcastle | 1734 | | | 1232 |
| West Nile Virus | 1504 | 917 | | |
| Yellow Fever | 1547 | 1035 | | |
| Metapneumovirus | 1185 | | | 765 |
| Norwalk Virus | 961 | 712 | | |
| Dengue Virus | 300 | 498 | | |

TABLE 4-continued

RPMV2 layout (Size)

| Respiratory Pathogen Name | Species/Sub-species | Species/Sub-species | Species/Sub-species | Genus/Species Rx Res |
|---|---|---|---|---|
| Foot & Mouth | 633 | 799 | | |
| St. Louis Encephalitis | 679 | 1035 | | |
| Rift Valley Fever | 738 | 798 | | |
| Usutu | 1035 | | | |
| tsutsugamushi fever | 546 | 1011 | | |
| Chandipura | 704 | | | 755 |
| Man-made Insertion Sequences | 2961 | 3914 | 2912 | |
| Multiple Cloning Sites | | | | |
| Rx Resistance Markers | | | | |
| Chip Size | | | | 293826 |

The sequences submitted for RPMV2 tiling and chip fabrication were based on the Affymetrix instruction file summarized in Table 5, which corresponds to the sequences appearing as SEQ ID NOs: 59-421.

TABLE 5

| RPMV2 Affymetrix instructions file for tiling and chip fabrication | | | | | | |
|---|---|---|---|---|---|---|
| Name | Alias | Start | End | SEQ ID NO: | StartSeq | EndSeq |
| ATTIM1 | ATTIM1 | 1 | 523 | 59 | ACATCGAC | GAGCTTGC |
| Ad3E1A | Ad3E1A | 1 | 879 | 60 | TGAGACAC | GGCAATGA |
| Ad3HEXON | Ad3HEXON | 1 | 595 | 61 | CCAGCACA | CATGTGGT |
| Ad3FIBER | Ad3FIBER | 1 | 746 | 62 | AAGCGGCT | AACCCTCA |
| Ad7E1A | Ad7E1A | 1 | 868 | 63 | TGAGACAC | AAACTGCC |
| Ad7HEXON | Ad7HEXON | 1 | 513 | 64 | CCAGCACA | TGCTGACG |
| Ad7FIBER | Ad7FIBER | 1 | 977 | 65 | TGACCAAG | ACGACTGA |
| Ad7NAVYE1A | Ad7NAVYE1A | 1 | 879 | 66 | ATGAGACA | AGGCAATA |
| Ad7NAVYHEXON | Ad7NAVYHEXON | 1 | 504 | 67 | CCAGCACA | TGCTGACG |
| Ad7NAVYFIBER | Ad7NAVYFIBER | 1 | 975 | 68 | TGGCTTTA | CCCCACGC |
| Ad16E1A | Ad16E1A | 1 | 878 | 69 | TGAGACAC | GGCAATGA |
| Ad16HEXON | Ad16HEXON | 1 | 667 | 70 | CGTTGACC | AGGACACC |
| Ad16FIBER | Ad16FIBER | 1 | 652 | 71 | GGGAGATG | AGGAAGCC |
| Ad21E1A | Ad21E1A | 1 | 878 | 72 | TGAGACAC | GACAATGA |
| Ad21HEXON | Ad21HEXON | 1 | 807 | 73 | CGCCACAG | GTGTACAA |
| Ad21FIBER | Ad21FIBER | 1 | 685 | 74 | GCTCAGTG | CCTTTATG |
| Ad11E1A | Ad11E1A | 1 | 872 | 75 | TGAGAGAT | GACAATAA |
| Ad11HEXON | Ad11HEXON | 1 | 677 | 76 | CGCCACAG | TCAGAAAG |
| Ad11FIBER | Ad11FIBER | 1 | 977 | 77 | TGACCAAG | ACGACTGA |
| Ad35E1A | Ad35E1A | 1 | 872 | 78 | TGAGAGAT | GACAATAA |
| Ad35HEXON | Ad35HEXON | 1 | 689 | 79 | CGCCACAG | TGAAAAAA |
| Ad35FIBER | Ad35FIBER | 1 | 971 | 80 | TGACCAAG | ACAACTAA |
| Ad1E1A | Ad1E1A | 1 | 986 | 81 | TGAGACAT | GGCCATAA |
| Ad1HEXON | Ad1HEXON | 1 | 715 | 82 | AGTGGTCT | TGCTACGG |

TABLE 5-continued RPMV2 Affymetrix instructions file for tiling and chip fabrication

| Name | Alias | Start | End | SEQ ID NO: | StartSeq | EndSeq |
|---|---|---|---|---|---|---|
| Ad1FIBER | AdIFIBER | 1 | 750 | 83 | GATGCTGT | AAGAATAA |
| Ad2E1A | Ad2E1A | 1 | 983 | 84 | TGAGACAT | GGCCATAA |
| Ad2HEXON | Ad2HEXON | 1 | 837 | 85 | AGTGGTCT | CGACCGGC |
| Ad2FIBER | Ad2FIBER | 1 | 750 | 86 | ATAGCTAT | AGGAATAA |
| Ad5E1A | Ad5E1A | 1 | 985 | 87 | TGAGACAT | GGCCATAA |
| Ad5HEXON | Ad5HEXON | 1 | 732 | 88 | AGTGGTCT | TGTAAAGC |
| Ad5FIBER | Ad5FIBER | 1 | 747 | 89 | ACAGCCAT | AAGAATAA |
| Ad6E1A | Ad6E1A | 1 | 985 | 90 | TGAGACAT | GGCCATAA |
| Ad6HEXON | Ad6HEXON | 1 | 833 | 91 | GAATGAAG | AATTGGGA |
| Ad6FIBER | Ad6FIBER | 1 | 750 | 92 | TCCTCAAA | CAGAAAAT |
| Ad4E1A | Ad4E1A | 1 | 865 | 93 | TGAGGCAC | GGCATTAA |
| Ad4HEXON | Ad4HEXON | 1 | 2810 | 94 | TGGCCACC | CCACATAA |
| Ad4FIBER | AdAFIBER | 1 | 1277 | 95 | TGTCCAAA | AACAATAA |
| Ad4AFE1A | Ad4AFE1A | 1 | 832 | 96 | TGAGGCAC | GACATTAA |
| Ad4AFHEXON | Ad4AFHEXON | 1 | 2810 | 97 | TGGCCACC | CCACATAA |
| Ad4AFFIBER | Ad4AFFIBER | 1 | 1277 | 98 | TGTCCAAA | AAGAATAA |
| Ad12E1A | Ad12E1A | 1 | 597 | 99 | ATGAGAAC | GGAGGTGA |
| Ad12HEXON | Ad12HEXON | 1 | 884 | 100 | CCTACTTC | TGCAAGAC |
| Ad12FIBER | Ad12FIBER | 1 | 908 | 101 | CAGCAGAA | CGTTGCCG |
| Ad17E1A | Ad17E1A | 1 | 579 | 102 | ATGAGACA | GAGGCTGA |
| Ad17HEXON | Ad17HEXON | 1 | 692 | 103 | CTTCAGCC | GAAGAATA |
| Ad17FIBER | Ad17FIBER | 1 | 829 | 104 | TCCTGTCA | TATCAGCC |
| Ad40E1A | Ad40E1A | 1 | 824 | 105 | CTTGAGTG | ATAGAAGA |
| Ad40HEXON | Ad40HEXON | 1 | 876 | 106 | CGCAATGG | TAATTACA |
| Ad40FIBER | Ad40FIBER | 1 | 707 | 107 | CACTGACA | TCAGTGTC |
| FluAHA1 | FluAHA1 | 1 | 1692 | 108 | ATGAAAGC | AATATGC |
| FluAHA2 | FluAHA2 | 1 | 805 | 109 | AAGGTCGA | TTTGGGAG |
| FluAHA3 | FluAHA3 | 1 | 1042 | 110 | CAAAAACT | AATGGTGG |
| FluAHA4 | FluAHA4 | 1 | 1371 | 111 | AGGAAATC | GACAAAGG |
| FluAHA5 | FluAHA5 | 1 | 303 | 112 | ATGCCCCA | TTTAACAA |
| FluAHA6 | FluAHA6 | 1 | 887 | 113 | CCGTCACA | GACTAAGA |
| FluAHA7 | FluAHA7 | 1 | 818 | 114 | AAATCCTG | TGGGAATT |
| FluAHA8 | FluAHA8 | 1 | 897 | 115 | CTCTTGGC | GCAAACCC |
| FluAHA9 | FluAHA9 | 1 | 601 | 116 | ACTCCACA | CCAAGGCC |
| FluAHA10 | FluAHA10 | 1 | 775 | 117 | CCTGGAGC | GTATGGTT |
| FluAHA11 | FluAHA11 | 1 | 728 | 118 | CTGCATTC | AGAGGCAA |
| FluAHA12 | FluAHA12 | 1 | 738 | 119 | CACTGTTC | GGCCAAAC |

TABLE 5-continued

RPMV2 Affymetrix instructions file for tiling and chip fabrication

| Name | Alias | Start | End | SEQ ID NO: | StartSeq | EndSeq |
|---|---|---|---|---|---|---|
| FluAHA13 | FluAHA13 | 1 | 1765 | 120 | AGCAAAAG | TTTCTACT |
| FluAHA14 | FluAHA14 | 1 | 763 | 121 | CACAAATG | CAAGAGGC |
| FluAHA15 | FluAHA15 | 1 | 793 | 122 | ACGGAGAC | CCCTTTGC |
| FluANA1-1 | FluANA1-1 | 1 | 1459 | 123 | CAAAAGCA | TTTCTACT |
| FluANA1-2 | FluANA1-2 | 1 | 575 | 124 | TGCCATGA | ATGATTTG |
| FluANA2 | FluANA2 | 1 | 1062 | 125 | TCATGCGA | TTTTAGAA |
| FluANA3 | FluANA3 | 1 | 852 | 126 | GCCCTTTC | TGAAGTCA |
| FluANA4 | FluANA4 | 1 | 257 | 127 | AGCAAAAG | CAGCCCCC |
| FluANA5 | FluANA5 | 1 | 913 | 128 | CGGTGAGA | GCGGGAAG |
| FluANA6 | FluANA6 | 1 | 739 | 129 | AGAGGATG | TTGCATTC |
| FluANA7 | FluANA7 | 1 | 994 | 130 | AGCAGGGT | ACACCAGC |
| FluANA8 | FluANA8 | 1 | 843 | 131 | CAATACAG | ATTAGCAG |
| FluANA9 | FluANA9 | 1 | 444 | 132 | AACCTGAA | GTCAATAT |
| FluAH1N1MATRIX | FluAH1N1MATRIX | 1 | 734 | 133 | ATGGAATG | TAAACACG |
| FluAH5N1MATRIX | FluAH5N1MATRIX | 1 | 657 | 134 | AGACCAAT | TTGCACTT |
| FluBHA | FluBHA | 1 | 785 | 135 | GGGAAGTC | AGGTAATA |
| FluBNA | FluBNA | 1 | 809 | 136 | GCCCTCAT | CTCGAACG |
| FluBMATRIX | FluBMATRIX | 1 | 763 | 137 | GGAGAAGG | ATGGCTTG |
| FluCHA | FluCHA | 1 | 401 | 138 | CTTCTTGC | ATGATCAT |
| FluCMATRIX | FluCMATRIX | 1 | 862 | 139 | ATGTCCGA | TTATATAA |
| PIV1HN | PIV1HN | 1 | 1728 | 140 | ATGGCTGA | CATCTTGA |
| PIV1MATRIX | PIV1MATRIX | 1 | 958 | 141 | CCGGAGAA | CAGTAGAA |
| PIV1NC | PIV1NC | 1 | 1682 | 142 | AGGGTTAA | AAGAAAAA |
| PIV2HN | PIV2HN | 1 | 1716 | 143 | ATGAAGA | TACCTTAA |
| PIV2MATRIX | PIV2MATRIX | 1 | 741 | 144 | CTTGCCTC | CAGGTCGG |
| PIV2NC | PIV2NC | 1 | 849 | 145 | AGATTCGG | AGAAAAAA |
| PIV3HN | PIV3HN | 1 | 1725 | 146 | ATGGAATA | AATCATAA |
| PIV3MATRIX | PIV3MATRIX | 1 | 544 | 147 | CCAACAAA | CCTGGCGA |
| PIV3NC | PIV3NC | 1 | 548 | 148 | ATGTTGAG | GCAACTAA |
| PIV4HN | PIV4HN | 1 | 686 | 149 | GACGGGAG | AAAGATTG |
| PIV4MATRIX | PIV4MATRIX | 1 | 855 | 150 | GGAACGGT | TTGGCTCA |
| HRV14NCR | HRV14NCR | 1 | 520 | 151 | TGATGTAC | GTTTCTCA |
| HRV1ANCR | HRV1ANCR | 1 | 511 | 152 | TTCCGGTA | GTTTCACT |
| HRV21NCR | HRV21NCR | 1 | 499 | 153 | TTCCGGTA | GTTTCACT |
| HRV29NCR | HRV29NCR | 1 | 676 | 154 | CGAAAACA | TTGGGTGT |
| HRV58NCR | HRV58NCR | 1 | 504 | 155 | TCACGGTA | GTTTCCTG |
| HRV62NCR | HRV62NCR | 1 | 501 | 156 | TTCCGGTA | GTTTCACT |

TABLE 5-continued

RPMV2 Affymetrix instructions file for tiling and chip fabrication

| Name | Alias | Start | End | SEQ ID NO: | StartSeq EndSeq |
|---|---|---|---|---|---|
| HRV87NCR | HRV87NCR | 1 | 506 | 157 | TCTTGGTA GTTTCACT |
| HRV95NCR | HRV95NCR | 1 | 508 | 158 | TTCCGGTA GTTTCTTG |
| RSVABL | RSVABL | 1 | 379 | 159 | AAGTGCTC AAGCAAAC |
| RSVAMATRIX | RSVAMATRIX | 1 | 958 | 160 | GGGGCAAA ATAAAAAA |
| RSVANC | RSVANC | 1 | 955 | 161 | TCCAACGG CCGAGGAA |
| RSVBMATRIX | RSVBMATRIX | 1 | 770 | 162 | ATGGAAAC GAGGATTA |
| RSVBNC | RSVBNC | 1 | 602 | 163 | GATGGGAG TACGCCAA |
| HCV229ESPIKE | HCV229ESPIKE | 1 | 1534 | 164 | GTTGATTG GCCGTGGT |
| HCV229EMEM | HCV229EMEM | 1 | 678 | 165 | ATGTCAAA TTTTCTAA |
| HCV229ENC | HCV229ENC | 1 | 924 | 166 | ATGGCTAC GTCACATT |
| HCVOC43SPIKE | HCVOC43SP1KE | 1 | 1456 | 167 | ATTGATTG GCCTTGGT |
| HCVOC43MEM | HCVOC43MEM | 1 | 693 | 168 | ATGAGTAG ATATCTAA |
| HCVOC43NC | HCVOC43NC | 1 | 966 | 169 | AGAGCTCA GTACACTT |
| SARSSPIKE | SARSSPIKE | 1 | 1438 | 170 | GTAGATTG GCCTTGGT |
| SARSMEM | SARSMEM | 1 | 666 | 171 | ATGGCAGA TACAGTAA |
| SARSNC | SARSNC | 1 | 932 | 172 | AGGGGGCA ACAAAGAT |
| HCVNL63SPIKE | HCVNL63SPIKE | 1 | 1534 | 173 | GTTGATTG GCCTTGGT |
| HCVNL63ORF3 | HCVNL63ORF3 | 1 | 678 | 174 | ATGCCTTT TTAATTGA |
| HCVNL63MEM | HCVNL63MEM | 1 | 681 | 175 | ATGTCTAA TAATCTAA |
| HCVNL63NC | HCVNL63NC | 1 | 879 | 176 | ATGGCTAG GTGAGGTT |
| MPVMATRIX | MPVMATRIX | 1 | 765 | 177 | ATGGAGTC CCAGATAA |
| MPVNC | MPVNC | 1 | 1185 | 178 | ATGTCTCT ATGAGTAA |
| HHV1L | HHV1L | 1 | 1061 | 179 | TACCAGGG AAGCGCCT |
| HHV1CAPSID | HHV1CAPSID | 1 | 993 | 180 | CGGGCGCC GTGGGCGT |
| HHV3L | HHV3L | 1 | 1061 | 181 | TATAAAGG CGTCGCTT |
| HHV3CAPSID | HHV3CAPSID | 1 | 993 | 182 | CGGGAGCC ATGGGCAT |
| HHV4L | HHV4L | 1 | 1067 | 183 | TACCAGGG ACCCAGAT |
| HHV4CAPSID | HHV4CAPSID | 1 | 992 | 184 | CGCCGACA CTGGGCAT |
| HHV5L | HHV5L | 1 | 1136 | 185 | TACCAGGG TCTAACCT |
| HHV5CAPSID | HHV5CAPSID | 1 | 998 | 186 | CGCGCAGC TGGGCCT |
| HHV6L | HHV6L | 1 | 1058 | 187 | TACAAAGG CCGAATCT |
| HHV6CAPSID | HHV6CAPSID | 1 | 1001 | 188 | CGCGCAGC TTGGGCAT |
| ENTEROVIRUS | ENTEROVIRUS | 1 | 1758 | 189 | CACCAATG GATAGATA |
| COXSACKIEVIRUS | COXSACKIEVIRUS | 1 | 920 | 190 | CAATGCAA TCTTGAGG |
| ECHO | ECHO | 1 | 1277 | 191 | CACTTGCC ACAAAGAG |
| POLIO | POLIO | 1 | 1226 | 192 | TGGATAGT ACTTATGT |
| POLIO1NCR | POLIO1NCR | 1 | 436 | 193 | CAAGCACT TGACAATC |

TABLE 5-continued

RPMV2 Affymetrix instructions file for tiling and chip fabrication

| Name | Alias | Start | End | SEQ ID NO: | StartSeq | EndSeq |
|---|---|---|---|---|---|---|
| POLIO2NCR | POLIO2NCR | 1 | 437 | 194 | CAAGCACT | TGACAATC |
| POLIO3NCR | POLIO3NCR | 1 | 437 | 195 | CAAGCACT | TGACAATC |
| MEASLESHA | MEASLESHA | 1 | 1854 | 196 | ATGTCACC | GCGGATAG |
| MEASLESMATRIX | MEASLESMATRIX | 1 | 1008 | 197 | ATGACAGA | TTCTGTAG |
| NEWCASTLEHN | NEWCASTLEHN | 1 | 1734 | 198 | ATGGACCG | CTGGCTAG |
| NEWCASTLEMATRIX | NEWCASTLEMATRIX | 1 | 1232 | 199 | ACGGGTAG | CATCAAGT |
| WNE | WNE | 1 | 1504 | 200 | TTCAACTG | GCACGCTG |
| WNNS | WNNS | 1 | 917 | 201 | GGCTGCTG | GGGAAGGA |
| WNCM | WNCM | 1 | 432 | 202 | GGCCAATA | TGATCCAG |
| YFE | YFE | 1 | 1547 | 203 | CTGCATTG | TAGAGACT |
| YFNS | YFNS | 1 | 1035 | 204 | AAGCTGTC | AGGGAGAG |
| VMVG3R | VMVG3R | 1 | 762 | 205 | ATGAAACA | GTGTCTGA |
| VMVHA | VMVHA | 1 | 942 | 206 | ATGACACG | AAGTCTAG |
| VMVSOD | VMVSOD | 1 | 378 | 207 | ATGGCTGT | GCGTTTGA |
| VMVCRMB | VMVCRMB | 1 | 291 | 208 | TCGGGAAC | CGTCTGTT |
| MONKEYPOX | MONKEYPOX | 1 | 812 | 209 | GTGAATGC | TTTCGACG |
| EBOLAL | EBOLAL | 1 | 800 | 210 | AGTTGGAC | GAAACACG |
| EBOLANP | EBOLANP | 1 | 806 | 211 | AGGAGTAA | CGACAATC |
| EBOLAMATRIX | EBOLAMATRIX | 1 | 1498 | 212 | GATGAAGA | AAGAAAAA |
| MARBURGL | MARBURGL | 1 | 1218 | 213 | GCGGCACT | CAATTGAC |
| MARBURGNP | MARBURGNP | 1 | 847 | 214 | TCACAGAA | GTCATTTG |
| LASSAL | LASSAL | 1 | 1021 | 215 | GCATCTGG | ACTACCTC |
| LASSANP | LASSANP | 1 | 751 | 216 | ATGGAGTG | AGTTCAGG |
| LASSAGP | LASSAGP | 1 | 1476 | 217 | ATGGGACA | AGAGATGA |
| MACHUPOL | MACHUPOL | 1 | 1588 | 218 | GTGGCTGA | GAGGCTAA |
| MACHUPONP | MACHUPONP | 1 | 763 | 219 | TTGAAGAC | GGCACTAT |
| MACHUPOG | MACHUPOG | 1 | 1491 | 220 | ATGGGGCA | GACATTAA |
| VEEVNS | VEEVNS | 1 | 923 | 221 | GACAGCCC | AAAGTGAC |
| VEEVNC | VEEVNC | 1 | 1512 | 222 | GGCCACCT | AGCATATC |
| EEEVNS | EEEVNS | 1 | 1312 | 223 | GAGATAGA | ATTGCGTC |
| EEEVNC | EEEVNC | 1 | 975 | 224 | CCTGACTT | TCAGCTAT |
| WEEVNS | WEEVNS | 1 | 878 | 225 | CGTATGTC | CCACAATG |
| WEEVNC | WEEVNC | 1 | 902 | 226 | TGTTCTAG | TGGCGACT |
| NIPAHMATRIX | NIPAHMATRIX | 1 | 1359 | 227 | AGGAGACA | ACAAAAAA |
| NIPAHN | NIPAHN | 1 | 858 | 228 | AGGAATCT | CAATCAGC |
| SINNOMBREGP | SINNOMBREGP | 1 | 1293 | 229 | ATAGCTGG | GGATGGAT |
| SINNOMBRENC | SINNOMBRENC | 1 | 639 | 230 | TCACTCTC | TGTGATTG |

TABLE 5-continued

RPMV2 Affymetrix instructions file for tiling and chip fabrication

| Name | Alias | Start | End | SEQ ID NO: | StartSeq | EndSeq |
|---|---|---|---|---|---|---|
| NORWALKL | NORWALKL | 1 | 739 | 231 | TTCTCCAT | ATTCGTAA |
| NORWALKCAPSID | NORWALKCAPSID | 1 | 760 | 232 | TGGTACCG | CTGGATGG |
| DENGUECAPSID | DENGUECAPSID | 1 | 300 | 233 | ATGAATGA | GACGTAGA |
| DENGUEM | DENGUEM | 1 | 498 | 234 | TTTCATCT | CAATGACA |
| DENGUE1NCR | DENGUE1NCR | 1 | 157 | 235 | GGTTAGAG | GCTGTCTC |
| DENGUE2NCR | DENGUE2NCR | 1 | 159 | 236 | GGTTAGAG | GCTGTCTC |
| DENGUE3NCR | DENGUE3NCR | 1 | 156 | 237 | GGTTAGAG | GCTGTCTC |
| DENGUE5NCR | DENGUE5NCR | 1 | 162 | 238 | GGTTAGAG | GCTGTCTC |
| FMDVVP1 | FMDVVP1 | 1 | 633 | 239 | ACCACCTC | CAAAACAG |
| FMDV3D | FMDV3D | 1 | 846 | 240 | GTTGATCG | ACGGAGCA |
| SLEVNS5 | SLEVNS5 | 1 | 1035 | 241 | AAGACTGG | AGGGTGAG |
| SLEVPP | SLEVPP | 1 | 727 | 242 | CTCGGTAG | GTTTCACG |
| RVFVN | RVFVN | 1 | 738 | 243 | ATGGACAA | CAGCCTAA |
| RVFVNS | RVFVNS | 1 | 798 | 244 | ATGGATTA | TTGATTAG |
| USUTUPP | USUTUPP | 1 | 1035 | 245 | AAGCTCGG | CAGGTGAG |
| JEVPP | JEVPP | 1 | 1035 | 246 | AAGCCTGG | AAGGAGAG |
| CHANDIPURAMATRIX | CHANDIPURAMATRIX | 1 | 755 | 247 | AACAGAAA | GAAAAAAA |
| CHANDIPURAGP | CHANDIPURAGP | 1 | 752 | 248 | ATCACTCT | GTAGTTGT |
| ATTIM2 | ATTIM2 | 1 | 523 | 249 | ACATCGAC | GAGCTTGC |
| ATTIM3 | ATTIM3 | 1 | 523 | 250 | ACATCGAC | GAGCTTGC |
| SPYEMM1 | SPYEMM1 | 1 | 398 | 251 | GCTTCAGT | CAGGCAAG |
| SPYEMM2 | SPYEMM2 | 1 | 360 | 252 | GCATCCGT | GAGAAGTC |
| SPYEMM3 | SPYEMM3 | 1 | 391 | 253 | ACGGCTTC | GGAATATC |
| SPYEMM4 | SPYEMM4 | 1 | 337 | 254 | AGCATCAG | GTCAATAT |
| SPYEMM5 | SPYEMM5 | 1 | 490 | 255 | ACTGCATC | AAAAGATA |
| SPYEMM6 | SPYEMM6 | 1 | 437 | 256 | TACTGCAT | CTTAAAAA |
| SPYEMM9 | SPYEMM9 | 1 | 509 | 257 | CAGGTACA | CTGCTCTT |
| SPYEMM11 | SPYEMM11 | 1 | 500 | 258 | GCATCCGT | AATCACCA |
| SPYEMM12 | SPYEMM12 | 1 | 364 | 259 | GCTTCAGT | AAATGATG |
| SPYEMM13L | SPYEMM13L | 1 | 325 | 260 | CAGCATCC | AAAAATCA |
| SPYEMM18 | SPYEMM18 | 1 | 524 | 261 | ACTGCTTC | GAAGAACA |
| SPYEMM22 | SPYEMM22 | 1 | 620 | 262 | GCATCAGT | GACGCAAG |
| SPYEMM28 | SPYEMM28 | 1 | 333 | 263 | CAGCATCC | AGAACGTC |
| SPYEMM29 | SPYEMM29 | 1 | 328 | 264 | TGCATCAG | AAGAACAG |
| SPYEMM44 | SPYEMM44 | 1 | 391 | 265 | CAGCATCA | CAAGAACA |
| SPYEMM61 | SPYEMM61 | 1 | 325 | 266 | GCATCAGT | AGAACGTC |
| SPYEMM75 | SPYEMM75 | 1 | 451 | 267 | TCCGTAGC | AAGCCGTG |

TABLE 5-continued

RPMV2 Affymetrix instructions file for tiling and chip fabrication

| Name | Alias | Start | End | SEQ ID NO: | StartSeq | EndSeq |
|---|---|---|---|---|---|---|
| SPYEMM77 | SPYEMM77 | 1 | 450 | 268 | GCTCAGTA | AGCTGAGC |
| SPYEMM89 | SPYEMM89 | 1 | 378 | 269 | CATCAGIA | AGAAAAGC |
| SPYEMM94 | SPYEMM94 | 1 | 516 | 270 | GCATCAGT | CAGACGCA |
| SPYCSR | SPYCSR | 1 | 952 | 271 | TGGTCCTA | CCCAGGCT |
| SPYSFB1 | SPYSFB1 | 1 | 615 | 272 | AGAACCTG | GGCATGAG |
| SPYSPEB | SPYSPED | 1 | 729 | 273 | ACTCTACC | TATCGATG |
| SPNGYRA | SPNGYRA | 1 | 815 | 274 | GAGGATTT | ACTGATAC |
| SPNLYTA | SPNLYTA | 1 | 99 | 275 | TATCGAAC | CTCAGACC |
| SPNPLY | SPNPLY | 1 | 99 | 276 | GGTTTGGC | ATCAAGAT |
| SAUGYRA | SAUGYRA | 1 | 821 | 277 | GAAGACTT | ACTAATGC |
| SAUTST | SAUTST | 1 | 705 | 278 | ATGAATAA | TFAATTAA |
| SAUENTK | SAUENTK | 1 | 729 | 279 | TGAAAAA | CGATATAA |
| SAUENTQ | SAUENTQ | 1 | 771 | 280 | ATGCCTAT | CTGAATAA |
| CPNGYRA | CPNGYRA | 1 | 824 | 281 | GAAGACAT | TCGAGTCA |
| CPNOMPB | CPNOMPB | 1 | 1030 | 282 | GCGAAGCT | TCAGGTCC |
| CPNMOMPVD4 | CPNMOMPVD4 | 1 | 150 | 283 | ATGCTGAT | TCAGATCA |
| CPNMOMPVD2 | CPNMOMPVD2 | 1 | 133 | 284 | AGCGTTCA | TAGGCGCT |
| CPNRPOB | CPNRPOB | 1 | 346 | 285 | AAGGACTT | CTGCAGGC |
| CPSOMPA | CPSOMPA | 1 | 991 | 286 | GGAACCCA | TCGATTCA |
| CPSSIGA | CPSSIGA | 1 | 883 | 287 | CGCAAGCT | GGTTCAGC |
| CDIDTX | CDIDTX | 1 | 913 | 288 | GACGTGGT | TTCTCCGG |
| CDIGYRA | CDIGYRA | 1 | 818 | 289 | GAAGACCT | ACCTCCGC |
| CDIDTXR | CDIDTXR | 1 | 1124 | 290 | AATGAGTG | GCGCCTGT |
| HINGYRA | HINGYRA | 1 | 896 | 291 | GAAGATTT | ACTGATGC |
| HINOMPA | HINOMPA | 1 | 937 | 292 | GCGTTAAA | CCAGACCG |
| LPNGYRA | LPNGYRA | 1 | 236 | 293 | GATGTCGG | GACCGTCG |
| LPNMOMPS | LPNMOMPS | 1 | 1157 | 294 | GTCCTTAC | TCATTAGA |
| MCAGYRA | MCAGYRA | 1 | 321 | 295 | AACTGGAA | AGATTCCC |
| MCAHA | MCAHA | 1 | 653 | 296 | GATCAATC | AATGGTCA |
| MTUGYRA | MTUGYRA | 1 | 818 | 297 | GAGGATTT | ACTTCCGG |
| MTUOMPA | MTUOMPA | 1 | 932 | 298 | GACGAACT | TCAACTAA |
| MTURPOB | MTURPOB | 1 | 411 | 299 | TACGGTCG | ACGCCGTA |
| MPNGYRA | MPNGYRA | 1 | 809 | 300 | GAGGACTT | TCTTCAGC |
| MPNP1 | MPNP1 | 1 | 2570 | 301 | CAGTTGCA | ACGCGAGC |
| NMEGYRA | NMEGYRA | 1 | 941 | 302 | GAAGACCT | ACCAGCGG |
| NMEMVIN | NMEMVIN | 1 | 904 | 303 | GATGAATA | ATACGGAA |
| NMECTRA | NMECTRA | 1 | 135 | 304 | TTGGATGC | TTTTGCTG |

TABLE 5-continued

RPMV2 Affymetrix instructions file for tiling and chip fabrication

| Name | Alias | Start | End | SEQ ID NO: | StartSeq | EndSeq |
|---|---|---|---|---|---|---|
| NMECRGA | NMECRGA | 1 | 254 | 305 | GGTGCTGC | TGCCGGTC |
| AHE16S | AHE16S | 1 | 489 | 306 | CGAACGCT | CCGGAAGG |
| AHEPLD | AHEPLD | 1 | 1111 | 307 | GCAAAGTG | CTCCTTTT |
| BANGYRA | BANGYRA | 1 | 732 | 308 | GAAGACTT | AGACTTGT |
| BANLEF | BANLEF | 1 | 685 | 309 | ATATCGAG | CTAGGTGC |
| BANPAG | BANPAG | 1 | 599 | 310 | CAGAAGTG | GGATAGCG |
| BANRPOB | BANRPOB | 1 | 777 | 311 | TAGTTCGC | AGGGGATA |
| BANCYA | BANCYA | 1 | 545 | 312 | GCGATGAT | CTGTCGAG |
| BANCAPB | BANCAPB | 1 | 246 | 313 | TTACACGT | ACCTATTA |
| BCERPOB | BCERPOB | 1 | 777 | 314 | TAGTTCGC | AGGGGATA |
| BSUGYRA | BSUGYRA | 1 | 812 | 315 | GAAGATCT | ACAGCTAG |
| BSURPOB | BSURPOB | 1 | 780 | 316 | TTGTTCGG | AGGCGACA |
| BTHCRY | BTHCRY | 1 | 853 | 317 | AGAACACA | ATCGCATC |
| BTHRPOB | BTHRPOB | 1 | 777 | 318 | TAGTTCGC | AGGGGATA |
| BPEGYRA | BPEGYRA | 1 | 815 | 319 | GAAGACCT | ACCACCGG |
| BPEPRNA | BPEPRNA | 1 | 777 | 320 | GGTTCAAG | CGCCGACA |
| BMEGYRA | BMEGYRA | 1 | 995 | 321 | GAAGACCT | TCGGATGG |
| BABRB51 | BABRB51 | 1 | 1339 | 322 | ATCCCATA | AGCTAGTA |
| BABOMP25 | BABOMP25 | 1 | 630 | 323 | AAGTCTCT | AGTTCTAA |
| BABOMP2 | BABOMP2 | 1 | 1434 | 324 | TGTTCTTC | GAGAGCAG |
| BCAOMP2 | BCAOMP2 | 1 | 1434 | 325 | TGTTCTTC | GAGAGCAG |
| BMEOMP2 | BMEOMP2 | 1 | 1434 | 326 | TGTTCTTC | GAGAGCAG |
| BNEOMP2 | BNEOMP2 | 1 | 1434 | 327 | TGTTCTTC | GAGAGCAG |
| BOVOMP2 | BOVOMP2 | 1 | 1449 | 328 | TGTTCTTC | GAGAGCAG |
| BSUIOMP2 | BSUIOMP2 | 1 | 1434 | 329 | TGTTCTTC | GAGAGCAG |
| BMAPENA | BMAPENA | 1 | 1117 | 330 | GAGAGCTG | AAGGTTCA |
| BMAWAAF | BMAWAAF | 1 | 1015 | 331 | CGTTGGTT | GGGATGCT |
| BPSPENA | BPSPENA | 1 | 1117 | 332 | GAGAGCTG | AAGGTTCA |
| BPSWAAF | BPSWAAF | 1 | 1100 | 333 | AGCGCGGC | GTCCGCGG |
| BCEPRECA | BCEPRECA | 1 | 611 | 334 | CATGGAAG | CAACCAGA |
| CPEGYRA | CPEGYRA | 1 | 810 | 335 | GAAGACTT | ATAAATAG |
| CPETMPC | CPETMPC | 1 | 1113 | 336 | ATGAAAAA | TAAATTAA |
| CBUGYRA | CBUGYRA | 1 | 812 | 337 | GAAGATTT | AGTGATAA |
| CBUTOLC | CBUTOLC | 1 | 745 | 338 | ATTTAGAC | CTAGGAAA |
| FTURD1A | FTURD1A | 1 | 531 | 339 | ATGAAAAA | CAATTTAG |
| FTURD1B | FTURD1B | 1 | 285 | 340 | ATGGCTTT | TAGACTAG |
| FTUTUL4 | FTUTUL4 | 1 | 834 | 341 | GGCGAGTG | CCAACCAC |

TABLE 5-continued

RPMV2 Affymetrix instructions file for tiling and chip fabrication

| Name | Alias | Start | End | SEQ ID NO: | StartSeq | EndSeq |
|---|---|---|---|---|---|---|
| FTUMDH | FTUMDH | 1 | 960 | 342 | ATGGCTAG | CAAAATAA |
| FTU13KD | FTU13KD | 1 | 431 | 343 | ATCGTAAT | TAAGTATG |
| FTUFOPA | FTUFOPA | 1 | 111 | 344 | CAGATATA | GATACTAC |
| OTSGROEL | OTSGROEL | 1 | 546 | 345 | GTTGAAGT | AAGAAAAA |
| OTSSTA56 | OTSSTA56 | 1 | 1059 | 346 | CTAGTGCA | AGCAGTAG |
| RPRGYRA | RPRGYRA | 1 | 968 | 347 | GAAGATTT | ACAAATAG |
| RPROMP1 | RPROMP1 | 1 | 985 | 348 | TATATAAA | ACAAGCTA |
| YPEGYRA | YPEGYRA | 1 | 812 | 349 | GAAGACCT | ACTGATGC |
| YPEOMPA | YPEOMPA | 1 | 913 | 350 | GTGGTAAA | CCAGATCG |
| YPECVE | YPECVE | 1 | 517 | 351 | GTACAGAT | TGAGGTAC |
| YPECAF1 | YPECAF1 | 1 | 525 | 352 | TATGAAAA | ATATAGAT |
| ACAHAG | ACAHAG | 1 | 1082 | 353 | GGTTGCGC | TGCTCTCG |
| ACAMAG | ACAMAG | 1 | 919 | 354 | CCGTCTGT | GTCATGTA |
| ACAGH17 | ACAGH17 | 1 | 810 | 355 | ACACACCA | AAAAAAAA |
| BDEWI-1 | BDEWI-1 | 1 | 942 | 356 | GGATCCAT | TTITTGTG |
| BDEBYS1 | BDEBYS1 | 1 | 912 | 357 | ATGCATCT | ATGATAAC |
| CIMAG2 | CIMAG2 | 1 | 1234 | 358 | CTCTCCCT | TTTTGTTA |
| CIMBG12 | CIMBG12 | 1 | 965 | 359 | ATAGAGGG | GAAACGAT |
| CPACP2 | CPACP2 | 1 | 735 | 360 | CTGAGGAA | TTCAAAAA |
| CPASOD | CPASOD | 1 | 375 | 361 | TTGAATTC | GTGATGTA |
| ECOGYRA | ECOGYRA | 1 | 812 | 362 | GAAGATCT | ACCGATGC |
| ECOOMPA | ECOOMPA | 1 | 660 | 363 | ATGAAGAA | CGCTGTAA |
| SENGYRA | SENGYRA | 1 | 812 | 364 | GAAGATCT | ACGGATGC |
| SENOMPA | SENOMPA | 1 | 904 | 365 | GTGCTAAA | CCGGATCG |
| SDYOMPA | SDYOMPA | 1 | 907 | 366 | GTGCTAAA | CCGGATCG |
| SFLGYRA | SFLGYRA | 1 | 812 | 367 | GAAGATCT | ACCGATGC |
| SFLOMPA | SFLOMPA | 1 | 898 | 368 | GTGCTAAA | CCGGATCG |
| VCHGYRA | VCHGYRA | 1 | 887 | 369 | GAAGAGCT | ACCAATGC |
| VCHOMPA | VCHOMPA | 1 | 942 | 370 | ATGAAAAA | TCCCTGAA |
| MSRA | MSRA | 1 | 400 | 371 | GCAAATGG | ATCACATG |
| MECR1 | MECR1 | 1 | 652 | 372 | ATGGAGGT | GAATCGAT |
| MEFA | MEFA | 1 | 611 | 373 | AATATGGG | ACTACGGC |
| ERMTR | ERMTR | 1 | 732 | 374 | ATGAAACA | TTCAATAA |
| ERMB | ERMB | 1 | 763 | 375 | GATGTATC | GGAAATAA |
| EMRB | EMRB | 1 | 1560 | 376 | ATGCCAAA | TTCACTAA |
| GYRB | GYRB | 1 | 1947 | 377 | ATGACAGA | ATGTCTAA |
| PARC | PARC | 1 | 2637 | 378 | GAGTTTGC | AATATAAG |

TABLE 5-continued

RPMV2 Affymetrix instructions file for tiling and chip fabrication

| Name | Alias | Start | End | SEQ ID NO: | StartSeq | EndSeq |
|---|---|---|---|---|---|---|
| PARE | PARE | 1 | 2008 | 379 | AAAATTTT | TGTTTTAA |
| PBP1 | PBP1 | 1 | 1282 | 380 | TTCGACCA | ACGAGCTA |
| PBP5 | PBP5 | 1 | 668 | 381 | TGACGATC | AACGAGCA |
| MECA | MECA | 1 | 729 | 382 | ATCGATGG | ATGAATAA |
| BLAZ | BLAZ | 1 | 846 | 383 | TTGAAAAA | AATTTTAA |
| DFRA | DFRA | 1 | 486 | 384 | ATGACATT | GGAAATAG |
| VANA | VANA | 1 | 1032 | 385 | ATGAATAG | AGGGGTGA |
| QACC | QACC | 1 | 324 | 386 | ATGCCTTA | CGCATTAA |
| RMTB | RMTB | 1 | 756 | 387 | ATGAACAT | ATGGATAA |
| STRA | STRA | 1 | 804 | 388 | TTGAATCG | GGGGTTGA |
| STRB | STRB | 1 | 837 | 389 | ATGTTCAT | CATACTAG |
| AADA1 | AADA1 | 1 | 792 | 390 | ATGAGGGA | GCAAATAA |
| SULII | SULII | 1 | 816 | 391 | ATGAATAA | TTCGTTAA |
| CTXM | CTXM | 1 | 436 | 392 | CAAGAAGA | ATGGCACC |
| KPC2 | KPC2 | 1 | 918 | 393 | CGTTGATG | CCACCACC |
| AMPC | AMPC | 1 | 1140 | 394 | ATGAAAAA | TGGAATAA |
| BLACMY2 | BLACMY2 | 1 | 1146 | 395 | ATGATGAA | TGCAATAA |
| AMPR | AMPR | 1 | 876 | 396 | ATGGTCAG | CGGCGTAA |
| SULI | SULI | 1 | 840 | 397 | ATGGTGAC | ATGCCTAG |
| AACAAPHD | AACAAPHD | 1 | 1440 | 398 | ATGAATAT | AAGATTGA |
| FLOR | FLOR | 1 | 1215 | 399 | ATGACCAC | TCGTCTAA |
| TETM | TETM | 1 | 536 | 400 | CACGCCAG | CGGAAATG |
| TETC | TETC | 1 | 502 | 401 | TATCGTCC | CAGTCAGC |
| TETS | TETS | 1 | 555 | 402 | GCTACATT | GGCATTCA |
| TETA | TETA | 1 | 494 | 403 | TGGCATTC | GCTATACG |
| TETG | TETG | 1 | 550 | 404 | CTCGGTGG | GGCTTTGC |
| TETL | TETL | 1 | 548 | 405 | CTGGGTGA | ATTCCTGA |
| TETB | TETB | 1 | 571 | 406 | AGTGCTGT | TCCAAGCC |
| PTX | PTX | 1 | 872 | 407 | ATCACTAC | CAGGAGCT |
| BONT | BONT | 1 | 792 | 408 | TGATGGAA | TTCTACGG |
| NTNH | NTNH | 1 | 496 | 409 | AATATTTG | AATATGGT |
| BOTE | BOTE | 1 | 1000 | 410 | GATAAAAT | TAACTATG |
| EPSILON | EPSILON | 1 | 620 | 411 | ATGCGAAA | GGAGGAGC |
| TETANUS | TETANUS | 1 | 1185 | 412 | CCTGATAA | CTAACGGA |
| STX1A | STX1A | 1 | 948 | 413 | ATGAAAAT | GCAGTTGA |
| STX2A | STX2A | 1 | 960 | 414 | ATGAAGTG | GTAAATAA |
| RICINUSTOXIN | RICINUSTOXIN | 1 | 1133 | 415 | ATGGTCCA | CATCGGAT |

TABLE 5-continued

RPMV2 Affymetrix instructions file for tiling and chip fabrication

| Name | Alias | Start | End | SEQ ID NO: | StartSeq | EndSeq |
|---|---|---|---|---|---|---|
| CTXAB | CTXAB | 1 | 984 | 416 | CGGGCAGA | CCTGAGGA |
| PBLUEVEC | PBLUEVEC | 1 | 236 | 417 | CTGCAGGA | TGCGTTGC |
| PGEMVEC | PGEMVEC | 1 | 226 | 418 | GAATATGC | TGCGTTGC |
| PUCVEC | PUCVEC | 1 | 252 | 419 | AGACAGTT | TGGGTTGC |
| ATTIM4 | ATTIM4 | 1 | 523 | 420 | ACATCGAC | GAGCTTGC |

Sample Preparation

In any embodiment of the present invention, the target nucleic acids (DNA and/or RNA) may be contained within a biological sample. The term "biological sample", as used herein, refers to a sample obtained from an organism or from components (e.g., cells) of an organism. The sample may be of any biological tissue or fluid. Alternatively, the sample may be one taken from the environment (air, soil or water). Frequently the sample will be a "clinical sample" which is a sample derived from a patient. Such samples include, but are not limited to, sputum, nasal wash, nasal aspirate, throat swab, blood, blood cells (e.g., white cells), tissue or fine needle biopsy samples, urine, peritoneal fluid, visceral fluid, and pleural fluid, or cells therefrom. Within the context of the present invention it is preferred that the clinical sample be a nasal wash, nasal aspiration or a throat swab. In a particularly preferred embodiment the clinical sample is a nasal wash. Biological samples may also include sections of tissues such as frozen sections taken for histological purposes, or from non-human animal sources, plants, or environmental sources such as water, air, or soil.

In order to be detected using microarrays, the target nucleic acids may require some degree of processing. For the intended purposes, this will involve one or more of the following target processing steps: (1) isolation, (2) enrichment for target sequences of interest, (3) amplification, (4) labeling, and (5) hybridization. Preferred embodiments corresponding to each of these processing strategies are described below; however, the present invention is not intended to be limited thereto. To this end, the skilled artisan would readily appreciate alternative methods corresponding to the aforementioned processing strategies both based on those commonly in use and as described in U.S. Pat. No. 6,638,717, U.S. Pat. No. 6,376,191, U.S. Pat. No. 5,759,778, U.S. Pat. No. 6,268,133, and U.S. Pat. No. 6,613,516 (each of which are incorporated herein by reference in its entirety).

Target Nucleic Acid Isolation

In an embodiment of the present invention, the target nucleic acids (RNA and/or DNA) to be assayed are isolated prior to amplification of the same. Methods of isolating nucleic acids are well known to the skilled artisan.

In a preferred embodiment, the target nucleic acid isolation may be performed using a MasterPure™ DNA Purification Kit (Epicentre Technologies, Madison, Wis.) ethanol purification method (per manufacturer's instructions). In another preferred embodiment, the target nucleic acids will be isolated using a rapid microcentrifuge technique, as in the use of Xtra Amp Kit (XTRANA, Inc. Broomfield, Colo.). In yet another preferred embodiment, the nucleic acids will be isolated using an automated device for said purpose, such as a GeneXpert (Cepheid, Sunnyvale, Calif.) or using a robot for magnetic bead-based isolation (e.g. Qiagen or Beckman).

A variety of other commercial products are available that are geared towards purification and concentration of nucleic acids from complex matrices. In addition to the methods described above and in the invention, alternatives include:

QIAamp DNA Mini Kit (Qiagen)—
(For Purification of Genomic, Mitochondrial, Bacterial, Parasite, or Viral DNA)

The QIAamp DNA Mini Kit simplifies isolation of DNA from human tissue samples with fast spin-column or vacuum procedures. DNA binds specifically to the QIAamp silica-gel membrane while contaminants pass through. PCR inhibitors such as divalent cations and proteins are completely removed in two efficient wash steps, leaving pure DNA to be eluted in either water or a buffer provided with the kit. QIAamp DNA technology yields genomic, mitochondrial, bacterial, parasite, or viral DNA from human tissue samples ready to use in PCR and blotting procedures.

RNeasy Mini Kit (Ambion)—

The RNeasy Mini Kit allows efficient purification of total RNA from very small amounts of tissue or cells. Total RNA is easily purified from animal cells or tissues, Gram-positive or Gram-negative bacteria, or yeast. RNeasy technology simplifies total RNA isolation by combining the stringency of guanidine-isothiocyanate lysis with the speed and purity of silica gel-membrane purification.

UltraClean™ Tissue DNA Kit (Mo Bio Laboratories, Inc.)—

Fresh or frozen tissue samples are homogenized using bead-beating technology to lyse the cells. Lysates are loaded onto a silica spin filter. During a brief spin, the DNA selectively binds to the silica membrane while contaminants pass through. Remaining contaminants and enzyme inhibitors are removed by a wash step. Pure DNA is then eluted into certified, DNA-free Tris buffer.

UltraClean™ Tissue RNA Kit (Mo Bio Laboratories, Inc.)—

Prepared fresh or frozen tissues are homogenized using a tissue homogenizer or mortar and pestle in the presence of lysis solutions. The RNA is captured on a silica membrane spin filter while contaminants are passed through the filter by centrifugation. The filter is washed to remove any remaining contaminants and salts. The RNA is then eluted into certified RNase-free water (provided). RNA is of high quality and is ready for any downstream applications.

Wizard® Genomic DNA Purification Kit (Promega)—

The Wizard® Genomic DNA Purification Kit is designed for isolation of DNA from white blood cells, tissue culture cells and animal tissue, plant tissue, yeast, Gram-positive and Gram-negative bacteria. The Wizard® Genomic DNA Purification Kit is based on a four-step process. The first step in the purification procedure lyses the cells and the nuclei. For isolation of DNA from white blood cells, this step involves lysis of the red blood cells in the Cell Lysis Solution, followed by lysis of the white blood cells and their nuclei in the Nuclei Lysis Solution. An RNase digestion step may be included at this time; it is optional for some applications. The cellular proteins are then removed by a salt precipitation step, which precipitates the proteins but leaves the high molecular weight genomic DNA in solution. Finally, the genomic DNA is concentrated and desalted by isopropanol precipitation.

SV Total RNA Isolation System (Promega)—

The SV Total RNA Isolation System provides a fast and simple technique for the preparation of purified and intact total RNA from tissues, cultured cells and white blood cells using this membrane-based purification system. The system incorporates a DNase treatment step directly on the membrane of the minicolumn. Purification is achieved without the use of phenol:chloroform extractions or ethanol precipitations, and there is no DNase carryover in the final RNA preparation.

RNAqueous Technology (Ambion, Inc.)—

RNAqueous kits can be used to purify total RNA from many different tissues and cells. Cells or tissue are disrupted in a guanidinium thiocyanate solution; this chaotropic agent effectively lyses cells and inactivates endogenous ribonucleases. The lysate is then diluted with an ethanol solution and applied to an RNA-binding glass fiber filter. Proteins, DNA and other contaminants are removed in three rapid washing steps, and the bound RNA is then eluted in concentrated form.

Nucleic Acid Isolation Robotics

In addition to those methods described above, several vendors (e.g. PSS BIO Instruments, Roche Diagnostics, Qiagen, Caliper) manufacture both small (benchtop) and/or high-throughput liquid handling robots and associated reagents that can be used instead of the manual methods described above. In a preferred embodiment, one or more such robots and their associated reagents will be used to automatically isolate nucleic acids for the subsequent processing (background removal and amplification).

Target Amplification

One set of technical challenges for pathogen detection with microarrays arises because of the difficulty in obtaining samples with a sufficient quantity of pathogen nucleic acids. Thus, for a majority of sample types, some sort of amplification will likely be required to provide sufficient copies of pathogen gene markers for detection by microarray hybridization. Multiplex PCR as a microarray preparative step is practically limited to tens of different primer pairs, not thousands, and increasing numbers of primer pairs give rise to varying numbers of spurious amplicons. However, discrimination occurs when the labeled amplicons are required to hybridize to specific probes on the array surface and, fortuitously, spurious amplicons may not detected by the microarray assay (Chizhikov et al., 2001).

Multiplex PCR

Conserved (degenerate) multiplex PCR serves to reduce the systemic bias introduced with specific PCR protocols by designing a series of primers selected to target the conserved regions flanking species-specific variable regions of a gene(s) to be probed. In the examples of the present application, the strategy for E1A, fiber, and hexon genes has been illustrated; however, the skilled artisan may expand this strategy to target any gene that is conserved across a broad spectrum of species, but still has species-specific variable regions. To this end, candidate genes and the specific regions (conserved and variable) can be readily identified by global or local homology searches (i.e., sequence alignment).

Applicants describe below a general strategy for the selection of targets and primer design:

As used herein the term "primer" (and generally appreciated in the art) refers to an oligonucleotide that is capable of acting as a point of initiation of polynucleotide synthesis along a complementary strand when placed under conditions in which synthesis of a primer extension product that is complementary to a polynucleotide is catalyzed. Typical polynucleotide synthesis conditions include the presence of four different nucleotide triphosphates or nucleoside analogs and one or more enzyme to catalyze polymerization (e.g., a DNA polymerase and/or reverse transcriptase) in an appropriate buffer ("buffer" includes substituents which are cofactors, or which affect pH, ionic strength, etc.), and at a suitable temperature.

To facilitate specific PCR, amplification primers typically range from 13 to 35 nucleotides, preferably from 20 to 25 nucleotides. The nucleotide sequence of the primer must have sufficient sequence complementarity to the target sequence in order to facilitate hybridization. Although the degree of complementarity will depend in large part on the length of the primer, the degree of complementarity generally is at least 80%, preferably at least 90%, more preferably at least 95%.

For random PCR protocols, the preferred primer length is from 6 to 10 nucleotides. The sequence would ideally include all permutations of a hexameric ($2^6$ permutations) to a decameric ($2^{10}$ permutations).

For the case of "prototype" region design, the preferred scenario would be to have conserved primers that flank variable regions of target genes. This was the case in RPMV1 for adenovirus and has been adopted by present inventors for Influenza A (using conserved 3' and 5' ends of Influenza A segments for hemagglutinin (HA) neuraminidase (NA) and matrix (M). This concept can be extended to any of a large number of pathogen types because highly conserved regions are ubiquitous in nature and degenerate primers can be designed for those sequences.

When targets are not selected as "prototypes", the amount of real estate on the chip can be greatly reduced compared to prototype regions. The objective in these cases is not necessarily to identify a particular strain or sub-variant of the species, but rather to allow for enough base calls to be made for an unambiguous statistical estimate demonstrating that the sequence corresponds to the pathogen of interest and not to a closely related species or non-virulent strain. With this chip design of multiple, small targets, it is not feasible to design and optimize conditions for the large number of specific PCR reactions that would be needed and total amplification becomes the optimal amplification strategy.

Homology, sequence similarity or sequence identity of nucleotide or amino acid sequences may be determined conventionally by using known software or computer programs such as the BestFit or Gap pairwise comparison programs (GCG Wisconsin Package, Genetics Computer Group, 575 Science Drive, Madison, Wis. 53711). BestFit uses the local homology algorithm of Smith and Waterman, Advances in Applied Mathematics 2: 482-489 (1981), to find the best segment of identity or similarity between two sequences. Gap performs global alignments: all of one sequence with all of another similar sequence using the previously described methods (Needleman & Wunsch, 1970). When using a sequence alignment program such as BestFit, to determine the degree of sequence homology, similarity or identity, the default setting may be used, or an appropriate scoring matrix may be selected to optimize identity, similarity or homology scores. Similarly, when using a program such as BestFit to determine sequence identity, similarity or homology between two different amino acid sequences, the default settings may be used, or an appropriate scoring matrix, such as blosum45 or blosum80, may be selected to optimize identity, similarity or homology scores.

Targets may also be amplified using a combination of specific PCR reactants in what is referred to as "multiplexed PCR". In this strategy, PCR primer pairs for all target regions on the RPM are combined into one reaction mixture. This is a preferred method in cases where one or more of the pathogens is present in too low a concentration to be detected using random amplification strategies alone (described below).

Random Amplification Strategies

Despite the sensitivity and specificity associated with PCR amplification, the inherent bias and limited throughput of this approach limits the principal benefits of downstream microarray-based applications. As successful identification depends almost entirely on appropriately chosen primer sets, all PCR-based testing requires a priori knowledge pertaining to the identity of the contaminating organism. As such, there remains a critical need for advanced diagnostic systems that can rapidly screen clinical and environmental samples without bias for specifically anticipated sequences. The advantage of microarray-based detection is that it can combine unbiased (e.g. random) nucleic acid amplification strategies with the subsequent discriminatory capability of microarrays, resulting in high sensitivity, specificity and throughput capacity.

The inventors have addressed the aforementioned issues through the use of alternative approaches and have investigated four front-end amplification strategies: random primed, isothermal Klenow polymerase-based, φ29 DNA polymerase-based and multiplex PCR (Vora et al., 2004).

Klenow-Based Amplification—

The Klenow fragment of DNA polymerase I can be used for isothermal, random amplification of target DNA of unknown sequence with random octamers oligonucleotide primers. For the present invention, this can be performed using the BioPrime® DNA Labeling System (Invitrogen). Biotinylated amplicons are generated (following the manufacturer's recommended labeling protocol with minor modifications). This process is typically performed at 37° C. for 4 hours. Klenow amplification results in some high molecular weight amplification products, but the vast majority of amplicons are 50-450 basepairs (bp) in length. As such, these amplicons are suitable for direct hybridization to DNA microarrays.

Random PCR Amplification—

Random PCR (rPCR) amplicons can be generated using the 2.5× Random Primers Solution and 10×dNTP mix from the Invitrogen BioPrime DNA Labeling System. The reaction components typically include: 1×PCR buffer (Qiagen), 2.5 mM $MgCl_2$, 1×dNTP Mix (containing biotin-14-dCTP), 5 µl of 2.5× random octamers and 5 U Taq DNA polymerase (Qiagen). The amplification reactions are performed using the following conditions for 35 cycles: 94° C. for 30 sec, 26° C. for 2 min, and 72° C. for 1 min.

φ29-based amplification—Isothermal φ29 DNA polymerase-based amplification with random hexamers can be performed using the TempliPhi™ 100 Amplification Kit (Amersham Biosciences Corp., Piscataway, N.J.). Biotinylated amplicons are generated following the manufacturer's recommended protocol with minor modifications (14.4 µl amplification reactions contained 0.4 µl enzyme mix and 3 µl of 350 µM biotin-14-dCTP and are incubated at 30° C. for 16 h).

The majority of both the rPCR and □29DNA polymerase amplification products are too large to migrate into electrophoretic gels (>1500 bp). Large amplification products hybridize poorly to immobilized probes on two-dimensional surfaces due to spatial and steric constraints (Vora et al., 2004). Thus, the rPCR and φ29 polymerase amplification products are digested with a DNase I fragmentation buffer to achieve amplicon sizes that are comparable to the Klenow and multiplex amplicons prior to hybridization.

Tandem Amplification

Increased sensitivity to pathogen targets can be achieved using a combination of the random amplifications strategies described above. Tandem [Klenow+Klenow] and [φ29+Klenow] tandem random amplification strategies can provide better sensitivity to enriched pathogen targets than multiplex PCR. The same random amplification strategies are also able to detect diagnostic genomic targets in spiked environmental water samples containing a 63-fold excess of contaminating DNA (Vora et al., 2004). The results presented underscore the feasibility of using random amplification approaches and begin to systematically address the versatility of these approaches for unbiased pathogen detection from environmental sources.

Combination of Target Enrichment and Random Amplification

Random amplification methods result in amplification of non-target DNA as well as target DNA. Thus, the inventors describe herein a variety of methods for enrichment of pathogen diagnostic target sequences in advance of random amplification steps. This is especially important to improve sensitivity and/or specificity of detection of analytes in complex matrices such as clinical (e.g. nasal wash or throat swab) or environmental (e.g. water, soil, air collector) samples.

Complex samples (clinical and environmental) contain significant, and sometimes overwhelming amounts of unknown genomes and genomes not of interest (non-specific background). One approach to reduce the non-specific background is to expose the nucleic acids to enzymatic processes that selectively digest the background genomic sequences. This process is described below within the examples.

Another strategy for reducing non-pathogen genomic content is to use background genomic sequences from a comparable complex sample known to be negative for the organism(s) of interest and use it to directly remove background genomic sequences. Such "subtractive" methods can include: (I) immobilization of the background genomes on solid phase surfaces such as gels or beads, followed by hybridization with the test sample to absorb background genomes from the samples. One can also use unlabeled background genomes during hybridization of targets on microarray to block the effects of non-specific binding due to the labeled background genomes. This blocking approach has the advantage in that it does not require additional steps during assaying. Both such strategies are also described in the Examples section.

Alternatively or concurrently, one can also use strategies to selectively enrich for the pathogen target nucleic acids prior to random amplification. One possibility for direct selection (also known as positive selection) from samples is to use immobilized probes on a solid phase support (magnetic beads or get matrices) to selectively enrich for genomic targets of interest. Ideally, the probes on the solid support should not be detectable on the array, as they would result in false signals in the event that the enrichment molecules are carried over or inadvertently amplified. As such, the probes on the beads should select for target genomes via an adjacent region or slightly overlapping with the region of the analytes' genomes to be queried on the microarray. If there is a slight overlap between the probe sequences and the analytes' sequences that is detectable on the array, then this queried region should be masked out during in silico analysis. In the event that it is desirable that the enrichment probes have homologous sequence to that on the microarray, then those probes should be comprised so as to not undergo subsequent amplification, or be made susceptible to selective enzymatic digestion prior to amplification. One can use combinations of the above and other strategies if necessary according to the specifics of the sample and applications of interest.

Alternative Subtraction or Enrichment Methods

Immunoprecipitation is another way to enrich the pathogens' nucleic acids. Antibodies for pathogens of interest could be mixed with clinical samples, then precipitated with anti-IgG to pull down pathogens, thereby removing background genomic DNA. This will be of particular importance when it is desirable to correlate specific genomic traits with a single pathogen, such as antibiotic resistance markers or indicators of intentional genetic manipulation.

Size exclusion is another method by which to subtract or enrich pathogen DNA. Exemplary size exclusion methods include: gradient centrifugation, column, or centrifugal filter units. Gradient centrifugation or column separation methods are time-consuming and require special set-up in the laboratory. The use of "centrifugal filter units" for separation of high- from low-molecular-weight species suffers from inconsistent and, often, low recovery rates. Each of these methods requires a large volume of starting material. Other size exclusion methods include: flow cytometry or electrophoresis methods, such as fluorescence-activated cell sorting (FACS) or with a special electrophoretic chip used in an Agilent bioanalyzer.

General Target Enrichment and Amplification Strategies

The present inventors have described methods for subtraction of "normal" human and microbial nucleic acids from nasal wash specimens. This same principle can also be applied to samples of any origin (clinical or environmental) where a representative "normal" mixture of nucleic acids can be collected, pooled, and prepared as a subtractive reagent.

A variety of approaches can also be applied to enrich for the pathogens or specific targets that are tiled on the array prior to performing a total amplification strategy. One such approach would use immobilized variants of the sequences that are tiled on the array. These variants would be bound to a solid phase component used for separation (beads, matrices, etc.) and serve to enrich for targets that will be amplified without being amplified themselves. Making the enrichment probes susceptible to enzymatic degradation can do this or they might be comprised of modified nucleic acids that would not be amplifiable.

A more preferred embodiment would utilize probes that recognize sequences that are adjacent to target gene sequences and not represented on the tiled regions of the chip. In this manner, their amplification in a non-biased amplification strategy would not result in artifacts.

As conventional DNA sequencing technologies can be considered as part of an overall information collecting process in basic research, so can the described resequencing approach be considered a component of an overall pathogen detection/characterization scheme. Wang et al. (Wang et al., 2003) describe a method for using a spotted DNA microarray comprised of long oligonucleotides (70-mers) that recognized conserved sequences, which are within a family of pathogens. Target sequences bound to these locations were isolated and used in a conventional DNA sequencing approach to allow further characterization. In an analogous manner, a very preferred embodiment would involve the use of the resequencing array to replace the steps related to alternative forms of DNA sequencing, thus providing specific pathogen characterization within hours instead of days and enablement of an effective biodefense system.

The method of the present invention preferably does not make use of specific sequences for amplification (PCR). The invention illustrates that there are alternate methods for enrichment of pathogen nucleic acids, for example: using solid phase support separations, prior to applying reduced bias, and isothermal (e.g. random-primed Klenow or strand displacement) amplification. In a preferable embodiment, a skilled technician in a conventional laboratory setting would be capable of performing time- and cost-effective sample preparation using a minimal set of automated steps to perform microarray experiments. In a highly preferred embodiment, a minimally skilled technician (medical technologist or medic) in a field environment (medical level 1) would be capable of performing manual separation/enrichment of pathogen target nucleic acids using a handheld instrument and perform isothermal amplification of pathogen targets with few reagents and technical steps.

Amplification and Hybridization Following Background Subtraction

In addition to random RT-PCR using primer D: GTTTCCCAGTCACGATCNNNNNNNNN (SEQ ID NO: 573), and Primer E: GTTTCCCAGTCACGATC (SEQ ID NO: 574) (Kessler et al., 2004), analogous, previously described primer sets (Wang et al., 2002), variants of those primer sets, and/or random (6-9 mers) to synthesize first strand cDNA from RNA viruses (pathogens) may be employed. A subtractive hybridization protocol could be employed after first strand cDNA synthesis is complete to reduce the amount of background DNA in clinical samples before subjecting complex (i.e. clinical or environmental) samples to one or more DNA amplification step(s).

One method is direct subtraction of the background genomic DNA from amplified products (first strand cDNA synthesis, then total amplification) in hybridization solution with COT-1 human DNA (which consists largely of rapidly annealing repetitive elements). Another method is bead-based subtraction of background genomic DNA from clinical sample after first strand cDNA synthesis and prior to the DNA amplification step.

The third method is the combination of the above methods. In this case, the human genomic background DNA from complex samples would be subtracted using bead-based subtraction after first strand cDNA synthesis and prior to the DNA amplification step(s). Subsequently, the background DNA could be further subtracted from complex sample in hybridization solution with sequences designed to selectively capture human DNA and RNA. The DNA amplification step itself could be aimed at amplifying the cDNA products formed in the random RT step specifically, non-specifically, or through a combination of methods to amplify both the specific primer site-labeled RT-PCR products as well as pathogen genomic DNA targets and other non-cDNA targets that did not arise from the random RT-PCR step. One approach for doing so would be to ligate a specific primer sequence to the pathogen DNA genomic targets (this could be the same primer as used attached to cDNA products or a separate one), allowing a single PCR step to amplify all RNA and DNA pathogen targets.

RNA Substraction

Where separate processing pathways exist for detection of RNA and DNA pathogens the following may be used. For development of the RNA processing pathway, spiked and clinical (nasal wash and throat swab) Influenza A positive specimens were processed using different methods (random, universal, and multiplexed PCR). However, to achieve acceptable levels of sensitivity with random amplification approaches, human messenger and ribosomal RNA should be subtracted using the MICROBEnrich™ kit (Ambion, Inc., Austin, Tex.) in accordance with the manufacturer's instructions. A preferred random amplification strategy may be employed adapted from a previously described method (Wang et al., 2002).

It was found by the present inventors that by employing this method positive detection of H3N2 and H1N1 Flu A detection in 16/19 different culture-positive Flu A nasal wash and throat swab specimens at concentrations as low as 0.45-3.75 pfu/150 µL sample aliquot may be achieved. It was further determined it was possible to detect Flu A in 6/8 specimens in the low concentration range following subtraction of human RNA.

Using random amplification approach, without background subtraction, the flu sensitivity is about 0.25 pfu/µl (1 ng/µl) in spiking nasal wash. In clinical samples, the sensitivity without subtraction is estimated to be about 1-10 pfu/µl.

DNA Substraction

Random amplification for DNA samples may be performed with either bacteriophage φ29 DNA polymerase or modified random amplification protocol from previously published paper (Wang et al. 2002; Wang et al. 2003). Briefly, DNA amplification utilizing bacteriophage φ29 DNA polymerase with random hexamers can be conducted according to the instruction of GenomiPhi™ DNA Amplification Kit (Amersham Biosciences Corp., Sunnyvale, Calif.). The amplified products are then ethanol precipitated according to manufacture recommended protocol. DNA amplification utilizing modified random amplification may be performed with initial round of DNA synthesis with Sequenase™ version 2.0 DNA polymerase (United States Biochemical, Cleveland, Ohio) using primer D, followed by PCR amplification with primer E. For RNA amplification, viral samples are then amplified by a modified version of a random PCR protocol (Wang et al. 2002; Wang et al. 2003; Kessler et al. 2004). Briefly, 10 µl of total RNA can be reverse transcribed by using primer D and superscript III reverse transcriptase (Invitrogen Corp. Carlsbad, Calif.), and was then amplified by PCR with primer E.

Convergence of RNA and DNA Pathways—

The combination of the RNA and DNA pathways is described in FIG. 9. In an embodiment of the present invention, the pathways for RNA and DNA are merged. This protocol is adapted from the lab of Joseph DeRisi at University of California San Francisco (http://derisilab.ucsf.edu/pdfs/Round_A_B_C.pdf) and randomly incorporates a single, fixed-sequence PCR primer binding site into all pathogen DNA or cDNA molecules, allowing them to all be amplified in a subsequent step using a conventional PCR thermal cycling protocol.

Data Acquisition and Processing—

Affymetrix/Microarray Apparatus

In general, a "microarray" is a linear or two-dimensional array of preferably discrete regions, each having a defined area, formed on the surface of a solid support. The density of the discrete regions on a microarray is determined by the total numbers of different target polynucleotides to be detected on the surface of a single solid phase support, preferably at least about $10^2/cm^2$, more preferably at least about $10^4/cm^2$, even more preferably at least about $10^6/cm^2$, and still more preferably at least about $10^8/cm^2$. As used herein, a DNA microarray is an array of oligonucleotide primers placed on a chip or other surfaces used to detect and/or isolate target polynucleotides. Since the position of each particular group of primers in the array is known, the identities of the target polynucleotides can be determined based on their binding to a particular position in the microarray.

One embodiment of the invention utilized standard Affymetrix hardware (Agilent GeneChip Scanner (phased out) and the Affymetrix Scanner 3000 workstation and Fluidics Station 450. In principle, the described invention does not require this equipment. Given the manufacturer's intended uses of the GeneChip system for quantitative gene expression profiling and high confidence SNP detection, the existing apparatuses are not optimized for the dynamic range of signal intensities or background interferences inherent to the present invention. Thus, a preferred embodiment incorporates the use of image acquisition methods, including the use of spatial frequency filtering and image enhancement, taking advantage of the inherent regularity of the feature dimensions to impose a filtering algorithm (e.g. edge enhancement, convolution, etc.) that allows better contrast of noisy images.

Affymetrix CustomSeq Protocol

In an embodiment of the present invention, sample processing is accomplished by employing the standard Affymetrix CustomSeq™ protocol. Generally, this method entails: (a) amplification of DNA probe-containing materials, (b) pooling and quantitation of amplified product, (c) fragmentation and labeling of the amplified product, (d) target hybridization, and (e) washing, staining, and scanning of the hybridized target. A detailed description of the Affymetrix CustomSeq™ protocol can be found in the product manual and protocol guide, which are available from the manufacturer and are incorporated herein by reference.

In the standard Affymetrix CustomSeq™ protocol, step (a) entails either long-range PCR or short-range PCR, with long-range PCR being the preferred amplification strategy. For each of these amplification strategies, the manufacturer recommended PCR DNA polymerases are Taq variants, AmpliTaq Gold DNA polymerase (short-range PCR) and LA Taq DNA polymerase (long-range PCR). Although not specifically recommended by the manufacturer, any DNA polymerase may be employed for step (a) so long as the DNA polymerase used is a high fidelity DNA polymerase.

To facilitate DNA amplification step (a), the standard Affymetrix CustomSeq™ protocol employs specific PCR primers. However, the use of specific PCR primers significantly limits the broad application of the inventive technique due to the introduction of systemic bias flowing from the specific PCR based methods that have heretofore been employed. Accordingly, in a preferred embodiment of the present invention step (a) of the Affymetrix CustomSeq™ protocol is replaced with an alternate amplification strategy, such as multiplex PCR, total amplification (GenomiPhi™), or random RT/PCR. These alternate strategies are discussed hereinabove. Conditions for optimal PCR amplification for each of the manufacturer recommended PCR strategies, as well as the preferred strategies of the present invention, can be determined by routine experimentation by the skilled artisan.

Since variability exists between PCR reactions, the Affymetrix CustomSeq™ protocol states that assay performance may be compromised if amplicon concentration in the hybridization varies by more than two fold. Therefore, step (b) of the Affymetrix CustomSeq™ protocol entails pooling PCR reactions and spectrophotometrically quantifying the same to ensure equimolar application of sample to the microarray.

However, the present invention poses several advantages over the SNP detection tailored protocols of the Affymetrix CustomSeq™ method. In particular, the use of the increased density chips with sequence length-independent similarity searches (BLASTN) in the present invention affords that fewer assumptions must be made in advance of selecting sequences for tiling. Furthermore, the use of length-independent similarity searches (BLASTN) removes the constraint that a particular known subsequence be successfully resequenced, making the approach more resistant to variations in target concentration and contributions from nonspecific binding leading to lost base calls. Accordingly, within the present invention step (b) of the Affymetrix CustomSeq™ protocol is optional and may be omitted.

Following DNA amplification, the DNA molecules obtained thereby are too long to hybridize with the short probes on the array surface. Accordingly, step (c) of the Affymetrix CustomSeq™ protocol involves fragmentation and subsequent labeling of the fragments with a fluorescent substrate. The method and reagents for fragmentation and labeling are not particularly limiting; however the label must be compatible with the detection apparatus for the resequencing microarray. To this end, the manufacturer recommended reagents and conditions may be employed.

Alternative Variations of the Affymetrix Protocols

Fluorescent labels that may serve to be advantageous for the methods described herein, as these are routinely used with automated instrumentation for simultaneous high throughput analysis of multiple samples, include the Cy fluorophores, the rhodamine based fluorophores: TARAM, ROX, JOE, and FAM; the BigDye™ fluorophores (Applied Biosystems, Inc.), the dansyl group, fluorescein and substituted fluorescein derivatives, acridine derivatives, coumarin derivatives, pthalocyanines, tetramethylrhodamine, Texas Red™, 9-(carboxyethyl)-3-hydroxy-6-oxo-6H-xanthenes, DABCYL™, BODIPY™, and ALEXA™ fluorophores (Molecular Probes, Eugene, Oreg.)

Additionally, there are a variety of labels other than fluorophores that will be suitable and perhaps preferable for a variety of situations. These labels include, but are not limited to: resonance light scattering (RLS) particles (InVitrogen, Carlsbad, Calif.), quantum dots (Quantum Dot Corp.) and other nanoscale particles having desirable optical qualities.

The target hybridization (step (d)) may be performed as described in the Affymetrix CustomSeq™ protocol. The highlight of this step is that the sample containing the fragmented and labeled DNA is denatured by a high temperature (e.g., 85-100° C., preferably 95° C.) incubation followed by a hybridization temperature (e.g., 45° C.) equilibration. Once the DNA-containing sample has equilibrated the sample is applied to the resequencing array. The manufacturer recommends conducting the hybridization reaction for 16 hours; however, as stated above, the method of the present invention does not have its hands tied to enhance sensitivity to make the appropriate base calls. Therefore, shorter incubation times are appropriate for target hybridization. Within the context of the present invention, the target hybridization incubation time may range from a short time of 15 minutes to a long of 24 hours. Clearly, it is contemplated that this range of times embodies each of the intermediate times as if they were explicitly stated. Preferable times worth noting are 15 minutes. 30 minutes, 1 hour, 2 hours, 4 hours, 12, hours, and 16 hours.

The last step of the Affymetrix CustomSeq™ protocol entails washing the hybridized array using the Affymetrix Fluidics Station and scanned using the Agilent GeneArray™ Scanner. This instrument simply automates what would otherwise be manually performable labeling and rinse steps. Thus, any instrument that would be capable of delivering and withdrawing milliliter quantities of labeling and rinse media on a timed basis would be a suitable alternative. The invention described herein will be amenable to any subsequent hardware variations offered by Affymetrix. In addition, data acquisition from the types of resequencing microarrays described herein may be obtained from any manufacturer of equipment for microarray processing.

Bioinformatics Issues Concerning Pathogen Detection—

Depending on the endpoints used for microarray-based detection of pathogens, the emphasis of bioinformatics issues is very different. Bioinformatic tools are indispensable for the efficient design and selection of specific complementary nucleic acid probe sequences for microarray development. For example, target pathogen genomic nucleic acid sequences are often amplified prior to microarray analysis and bioinformatics clearly has a role in the design of primers (assessing $T_m/T_a$, secondary structure, self-complementarity, and specificity issues) for assaying genes considered specific to an organism and strain (Kampke, Kieninger & Mecklenburg, 2001). These same assessments must also be made for microarray probe design.

During the initial stages of experimental design, it is assumed that primers and probes to genetic signatures associated with a target pathogen are specific to that pathogen or family of pathogens. It would follow that the generation of an amplicon or positive hybridization reaction using specifically designed primers or probe, respectively, would indicate the detection of the designated molecular trait from the target pathogen; however, this is not necessarily true. Bacterial and viral 'genetic promiscuity', the propensity of microorganisms to exchange genetic material, creates difficulties in developing single species or strain specific probes (Ochman, Lawrence & Groisman, 2000). Thus, preferred primer and probe design methodologies require the use of bioinformatic tools to: (a) perform multiple sequence alignments between different organisms or strains and design appropriate primers with the appropriate biochemical properties, (b) compare these sequences with those deposited in sequence databases to determine the present uniqueness of particular sequences and the potential for cross-reactivity, and (c) infer the probability of target specificity based on the level of genetic conservation and evolutionary relatedness with other pathogenic and non-pathogenic species whose primary genetic sequence has not yet been elucidated.

A very important bioinformatics aspect of the disclosed invention involves the assembly, annotation and selection of pathogen diagnostic targets into database(s) for incorporation into microarray design, as well as the concomitant task of relating detection events on the microarray to such database(s). An advantage of the present invention is that the information contained in the publicly available databases is ever increasing, thus further adding to the robust nature of the present invention. The present invention describes a process of manually selecting pathogen target sequences from the published literature (e.g. GenBank) and/or ascertaining an empirically determined diagnostic target sequence from published literature. The described approach has the advantage that a consortium of scientists, each possessing sufficient "domain expertise" for each of a large number of disparate pathogen species, can provide relevant, pathogen diagnostic sequence information that can be incorporated into an automated array design process without specific regard to specific probe, reagent, amplification, and sample preparation methods.

In one very preferred embodiment, the requisite domain expertise for each of a large number of unrelated pathogens will be maintained in an up-to-date fashion through a web-portal enabled database. Thus, an extended consortium, comprised of individual researchers of specific pathogens, would be able to provide the latest annotated target sequence information via a "pathogen page" formatted web portal, analogous to the "molecular page" model adopted by the Alliance for Cellular Signaling (AfCS). The AfCS database then maintains an otherwise incomprehensible amount of specific information on thousands of molecules involved in intracellular signaling cascades. In this format, individual researchers without specific knowledge about individual signaling molecules can access detailed parameters that can be used in numerical simulations of signaling events. Thus, in another very preferable embodiment, the annotated target sequence data for individual pathogens is organized into an automated data pipeline in which will impose user-defined design constraints (e.g. number of probe features, number of pathogen targets, the levels of sensitivity and specificity required for array performance, etc.) upon the total information content of a pathogen database, allowing automated, optimal target selection and submission of those targets to a vendor in a format necessary for microarray fabrication.

In yet another very preferred embodiment, the selected target sequences determined by the previous process will be correlated with the data that is collected in actual use of the microarray, such that metrics for probability and quality can readily used for decision-making. Two preferable approaches for performing such automated pipelining of data and algorithms are VIBE (Visual Integrated Bioinformatics Environment) software (Incogen, Inc., Williamsburg, Va.) and iNquiry (BioTeam, Boston, Mass.) which are representative of a class of integrated bioinformatics environments that could be used to equal effect for the intended purpose.

Data Acquisition—

Raw sequence data from the resequencing microarray chips is provided by the Genetic Data Analysis Software version 2.0 (GDAS) packaged with the microarray reader from Affymetrix.

The Affymetrix resequencing array contains a defined number of probe cells or features. During scanning, the software divides each feature into subunit squares or pixels (3×3 µm). Each feature contains many copies of a unique 25-base oligonucleotide probe of defined sequence, while a series of eight features query a specific site in a known reference sequence. Four features interrogate the sense strand and contain probes that are identical except for the central base which is A, C, G, or T and four features interrogate the anti-sense strand and contain probes that are identical except for the central base which is A, C, G, or T.

GDAS uses the cell intensity data to make base calls for every base position represented on the resequencing array. Under the manufacturer setting for GDAS, the algorithm uses the intensity data from multiple samples to improve its calling accuracy and assigns a quality score for each call.

GDAS base calling is based on a previously described base-calling algorithm, ABACUS, detailed in (Cutler et al., 2001)). The model assumes that the pixel intensities of a feature are independently and normally distributed. The algorithm computes the estimated mean background and variance for the sense and anti-sense strand features. The base-calling algorithm also specifies models for the presence or absence of various genotypes in the sample (haploid or diploid). A variety of base calling algorithm parameters can be defined by the user (GDAS operator's manual/user's guide, Affymetrix) to obtain a trade-off between base calling percentage and accuracy.

Additional information regarding the GDAS algorithm and the parameters that can be modified is available in the GDAS user manual, which is incorporated herein by reference in its entirety. A description of the parameters is found in the GDAS version 2.0 manual on pages 207-217. The recommended (default) settings for GDAS are "conservative" settings that focus on the highest level of accuracy. In contrast, the objective of the present invention is to increase the percentage of base calls. To achieve this objective, the present inventors adjusted the parameters to allow highly permissive base calls (increased percentage) as listed below:

"Permissive" Base Calling Algorithm Settings—
  Filter Conditions
    No Signal threshold=0.500 (default=1.000000)
    Weak Signal Fold threshold=20000.000 (default=20.000000)
    Large SNR threshold=20.000000 (default=20.000000)
  Algorithm Parameters
    Strand Quality Threshold=0.000 (default=0.000000)
    Total Quality Threshold=25.0000 (default=75.000000)
    Maximum Fraction of Heterozygote Calls=0.99000 (default=0.900000)
    Model Type (0=Heterozygote, 1=Homozygote)=0
    Perfect Call Quality Threshold=0.500 (default=2.000000)
  Final Reliability Rules
    Min Fraction of Calls in Neighboring Probes=1.0000 (disables filter)
    Min Fraction of Calls of Samples=1.0000 (disables filter)

The settings above are significant in the present application because the base call algorithm is set up by default to sacrifice the number of base calls made in order to make the most accurate calls (i.e., for SNP detection). In the present application, the technique is less concerned about achieving the same degree of accuracy as required for SNP detection but instead expanding the number of calls made so that the longest possible stretches of contiguous sequence are produced by GDAS while maintaining necessary specificity.

It is to be understood that within the scope of the present invention, the above-listed permissive settings can be altered individually or in toto as desired by the practitioner to obtain an optimal sensitivity/specificity agreement. In addition, it is to be understood that the settings above are exemplary and that each setting may be altered by 10% or more (parameter dependent) without altering the desired result of the present invention.

Resequencing Pathogen Identifier (REPI) and Alternatives, Modifications, Developments Also according to the invention, it is the sequence information derived from a base-calling algorithm, as applied to the microarray hybridization pattern that is used to identify individual pathogens. Preferably, the sequence of target sequences determined by the resequencing probes is used to query a database using a similarity search algorithm. More preferably, the algorithm uses commonly used local alignment (e.g. Smith-Waterman, BLASTN) sequence alignment algorithms to statistically determine the probability that a given target sequence corresponds to a specific sequence in a database record (Korf, Yandell & Bedell, 2003). Even more preferably, a custom algorithm that determines subsequences that are most suitable for producing meaningful similarity searches against database records determines the set(s) of sequences that are submitted for similarity search automatically. Yet even more preferably, the automated subsequence-parsing algorithm is the Resequencing Pathogen Identifier (REPI) algorithm described in this invention and the sequence database records will be in both the public (e.g. GenBank) and private domain. Variants of nucleic acid sequence similarity search algorithms that are suitable for use in the intended invention include, but are not limited to: Washington University BLAST (WU-BLAST). NCBI-BLAST, FastA, MPsrch, Scanps, and BestFit (Korf et al., 2003).

REPI Alternatives and Variants

In the described invention, REPI (Resequencing Pathogen Identifier) software (see U.S. Application Ser. No. 60/609, 918 filed on Sep. 15, 2004, and U.S. Application Ser. No. 60/631,460, filed on Nov. 29, 2004, which are incorporated herein by reference in their entirety) was used to ascertain which base call subsequences from the CustomSeq/GCOS/GDAS process would likely return significant BLAST results through the use of a customized sliding window algorithm. Subsequently, REPI automatically returns BLAST outputs to the end user that allow probabilistic assignments to the likelihood that a given set of base calls correspond to a particular microbial sequence. This low-level software functionality is analogous to the "kernel" of UNIX or UNIX-derived computer operating system, in that all higher-level functions and user interfaces must pass though it for resequencing chip analysis.

The low-level functionality provided by REPI will be central to a number of higher bioinformatics tasks that will utilize discontinuous segments of nucleic acid, or even amino acid sequence. In the following examples, the present inventors provide data showing that sequence fragments can be linked automatically to individual pathogens. In several more preferred embodiments, this approach can be refined to better discriminate between mixtures of pathogens and genetic recombination between pathogens. In one very preferred embodiment, the analysis software would allow for automatic detection of overlapping or homologous sequence fragments on different tiled regions of the array, allowing inference of a mixture of pathogens. In an even more refined embodiment, the analysis software would determine that the sequence outputs from different tiled regions are not overlapping but correspond to contiguous sequence that may be used to infer a genetic recombination event.

For example, a co-infection of two strains of a virus may produce a recombinant with a gene that is homologous with one virus strain except for the 5' end, which has been substituted with the corresponding section of gene for the other virus strain. When this new recombinant virus genome is hybridized on a resequencing microarray, it produces signal from the corresponding pieces of both regions. One would need to have an assembly algorithm to construct a "model" of the pathogen showing which parts might fit together to form an entire target. If the two have significant overlap, one might conclude that there is probably a mixture. But if there were no overlap, there would remain a possibility that there is a recombinant. The degree of overlap (or lack of) could be affected by low concentrations of target with correspondingly smaller amounts of the tiles being filled in. This same principle can be applied even more readily, and with greater impact, on viruses where the recombination is a steady and recurring event, as in the case of influenza, where recombinations between viral segments result regularly in the formation of new viral strains. In fact, this described functionality in REPI will be essential for the distinction of pathogen mixtures versus recombination.

In another very preferred embodiment, REPI algorithms will allow for the analysis of transcriptional markers (e.g. RNA) that have been resequenced using the presently described type of microarray (via hybridization of RNA or complementary cDNA). In a method analogous to that described above for inference of genomic recombination events, transcriptional sequences may also be assembled to determine pathogen viability and transcriptional editing events that can serve as markers for infection.

Another REPI Alternative (Estimating the Amount of Pathogen Target in a Sample)

Not only is the present inventive approach able to distinguish between mixtures of pathogens and recombination events within a given pathogen (described elsewhere herein) it would also be of great value to provide the end user with an estimate (quantitation) of the relative amount of pathogen that was detected in the resequencing microarray assay. In particular, this would be of great utility when the clinician (technician) attempts to assign cause and effect when multiple pathogen genomic signatures are detected.

Two types of data may be used for this purpose. The first is the absolute intensity of the hybridization signals on the chip. A non-linear relationship exists between the amount of target in solution and the amount that actually hybridizes and the resulting signal. However, an estimate of the amount of target nucleic acid in the sample could be made by comparison with a standard curve prepared under control conditions. The signal intensity data is readily available from the .CEL file in the Affymetrix data hierarchy, and although the content of the .CEL files were not used in this disclosure, the output of REPI could easily be modified to include the intensity values of the .CEL files. Secondly, the percentage of base calls, both as a percentage of the total tile region size and as a percentage of base calls within a selected subsequence satisfying the sliding window algorithm, could be used as a measure of concentration. Our results show that both of these percentage metrics decrease with decreasing target concentration, although the correct pathogen can still be identified.

General Utility for Pathogen Detection

In a preferred embodiment, the invention described herein will be used for the routine diagnosis and surveillance of common respiratory pathogens in a clinical setting (at or near point-of-care). Readily obtainable samples (e.g. nasal wash, nasal swab, throat swab, sputum, or blood) will be processed in a simple manner to produce nucleic acid isolates that are obtained using an adsorptive process, enriched for pathogen-specific targets, amplified using a non-biased (e.g. total) amplification method or multiplexed PCR method, and hybridized on the resequencing microarray for a minimal amount of time prior to washing and imaging. The overall process will be sufficiently simple such that a skilled technician (medical technologist level) will be able to perform the assay without a significant interruption in their routine work pattern. Base calls will be made using the custom algorithms or using the steps specified by the vendor. REPI, or some variant thereof, will be used to automatically parse the base calls made by the microarray, and provide the end-user (e.g., physician, health care provider, public health officer, or other decision-makers) with decision-quality information for management (e.g., diagnostic, treatment, prognostic and outbreak control/containment measures) of the infectious pathogen(s) that are causative of the disease symptoms and complications. This analysis would occur locally through the use of an embedded sequence database that would be queried by REPI (e.g. local dedicated BLAST server). In addition to providing a routine diagnostic functionality, the microarray will also carry markers for highly improbable (i.e. bioterrorism) pathogens that would be cause for involvement of others, namely public health officials. However, it is understood that a nasal wash or throat swab may not be the optimal sample type for diagnosis of bioterrorism agents and that a separate sample type may be needed.

Also within the scope of the present invention, which further demonstrate the utility of the microarrays and methods of the present invention, include:

Scenario 1:

Patient arrives to medical facility with T>100.5 and respiratory symptoms. Nasal wash and/or throat swab are taken. Pathogens which can be identified by this route include the commonly occurring pathogens including those listed in Table 1. The presence of fever has been found to be an important criteria for isolating respiratory pathogens by culture and literature demonstrates that pathogens are typically present at peak titer during febrile periods.

For the bioterrorism agents, little information is available in the literature on infectious titers in respiratory secretions after intentional release of a biological agent. It is suspected that an aerosol release of an agent of bioterrorism would lead to detectable titers of organism in the first 24 hours post-exposure. In individuals presenting after the first 24 hours post-exposure, the microarray would serve the purpose of identifying common pathogens that might be otherwise erroneously suspected of being cases from the BT/BW agent. A proportion of individuals exposed to a significant aerosol release will develop symptoms rapidly and will retain the BT/BW agent in the nares for detection. For a disease, such as smallpox, the incubation period for onset of symptoms is much longer, but the virus can be isolated from throat culture for days.

Scenario 2:

The individual has been ill for days and did not initially present to a medical clinic, but chose to self-medicate. Patient may not have initially noted fever, but now has fever and respiratory symptoms and is concerned about lack of resolution. Health Care Practitioner (HCP) sees patient and determines appropriate clinical sample. If patient appears more ill, then chest X-ray may be acquired. Common organisms causing lower respiratory tract infection include, but are not limited to: *Mycoplasma pneumoniae, S. pneumoniae, C. pneumoniae, L. pneumophila, S. pyogenes*, Influenza A/B, RSV, Parainfluenza, *S. aureus*, SARS. Amongst the BT/BW agents of concern, an abnormal chest x-ray can be found with *B. anthracis*, Smallpox, *Y. pestis, F. tularensis*. For the common respiratory organisms, nasal wash/throat swab can still be appropriate sample techniques, although some practitioners will choose to send a sputum samples. For the BT/BW agents, sputum and blood can be appropriate sample techniques.

Scenario 3:

Ongoing outbreak of a known agent. The microarray can continue to be useful for detecting cases of other common pathogens, but may also be used to screen for known BT/BW agent using any type of appropriate specimen. Other assays may prove less expensive, but the microarray can provide forensic information and antibiotic resistance data at the time of pathogen identification.

Overall Business Model

The resequencing DNA microarray and associated devices (to include other types of lower content microarrays or alternative sequence detectors) will be but one class of elements of an integrated pathogen diagnostic/surveillance system. This system will be comprised of diagnostic, informatic, and epidemiologic components. At the diagnostic level, the RPM (and ancillary devices) will provide a rapid and cost-effective methodology for providing a diagnosis, patient-specific treatment information, and prognostic information (based on virulence and resistance markers) of infectious respiratory disease. This will represent a shift in diagnostic emphasis for the provider from clinical suspicion of one or a few pathogens (e.g., *Mycoplasma pneumoniae* and other pathogens with a presentation of "walking pneumonia" would be tested by obtaining bacterial cultures, presence of antibodies to that pathogen, etc.) to symptom-based and broad differential testing by multiplexed DNA microarrays based on the symptom(s) and the organ system or systems effected. The single highly multiplexed DNA arrays will additionally provide diagnostic information on which group of pathogens to treat (e.g., bacteria, viruses, parasitic, and fungal pathogens) producing substantial return on investment by reducing the number of prescriptions based on suspicion of causal agents (e.g., prescribing antibiotics for a viral respiratory infection will have no effect). Additional diagnostic applications can be created to cover all pathogens effecting an organ or organ systems (e.g., respiratory, genitourinary, central nervous system, etc.), syndromes (e.g., fever of unknown origin evaluated in the hospital for two weeks without identifying the cause to rule out all potential infectious disease causes), symptoms (e.g., all pathogens causing a urticaria or rash that itches, or cough, etc.), around collections of pathogens or threats present in geographic locations, or functional categories (e.g., groupings based on all the organisms known to have antimicrobial resistance in hospital or other confined settings like prisons or nursing homes). This highly multiplexed differential diagnostic testing will be done by determining the causative agent(s) of infection, antimicrobial susceptibility of the agent(s), and genomic sequence-specific clues as to the nature of the agent such that the maximum number of opportunities is identified to increase the efficacy and efficiency of clinical management.

However, because of the high number of specific molecular queries that are being made, a large number of pathogens can be detected, each at previously unattainable levels of detail. As such, a large number of assays (culture, serotyping, and PCR confirmation) that are subsequently and infrequently performed as part of "surveillance" activities are now being performed simultaneously with diagnosis, obviating the need for burdensome and expensive tasks currently required at the clinical level for surveillance support. This would have great relevance to diagnosis and surveillance of variants of RNA viruses (e.g. Influenza and SARS) in a manner that would be prohibitively complicated when relying on specific oligonucleotide probe sets.

In the specific embodiment described here, it will be highly advantageous to have diagnostic microarrays, the fabrication of which will not rely on the availability of a large number of target sequences and a means to fabricate arrays using them. More importantly, it will be critical not to be restricted to the assumption that the target sequences are invariant. Diagnostic DNA microarrays will identify specific but unanticipated genomic variants of a model pathogen, without requiring re-design of specific oligonucleotide probes and array re-fabrication. This will be critical to the ability to characterize the cause(s) of infectious disease outbreaks in a time-effective manner. For example, such microarrays could be used to rapidly detect new variations of influenza or SARS virus without requiring that the pathogens be isolated, cultured, and sequenced using conventional approaches; a process that would require weeks to months if the pathogen were readily cultivable.

The present invention also embraces applications for detecting a mixture of pathogens, especially when there is no preliminary evidence to suggest that the mixture might be interrogated by specific reagents (e.g. PCR primers). Thus, the present invention provides a means to impact the ability to determine the complementary roles of interacting pathogens in disease etiology. However, in applications such as viral or bacterial stock quality control and assessment of viral vaccine production, which involves the intentional mixture of field strain and cultivable viruses to produce recombinants that culture well. Thereby, the present invention enables the presentation of the correct the appropriate epitope(s) for vaccine efficacy.

The informatics component of the system will provide the necessary components to allow local (point-of-care), automatic microarray data analysis as well as coordinate multi-directional information transfer. "Upward" flow of information will entail the transfer of specific sequence base calls from the resequencing chip, preferably in FASTA format, and all associated local processing results, to local, regional, national and international levels. "Lateral" flow of information will involve the exchange of specific sequence base calls and associated local processing results to other local point-of-care medical facilities. "Downward" flow of information is defined as a provision of national level data integration to regional and local health officials.

Like clinical samples, environmental samples may contain small amounts of target nucleic acids in a high genomic background of unknown origin. But unlike clinical samples of a given type, the background found in an environmental sample (e.g. soil, water, or collected from an aerosol particle collector) might show a more heterogeneous composition depending on the geographical location, season, and environmental conditions. Accordingly, the aforementioned amplification, enrichment and/or subtraction strategies may be employed to obtain reliable base calling.

Forensic and Environmental Applications

The amount of detailed sequence information provided by the RPM will be enabling for various applications other than medical diagnosis and surveillance. Thus, the capability of the apparatus extends to forensic fingerprinting of specific pathogen strains. The capability enables preemptive diagnosis of etiologies of infectious disease, as alternative to conventional practice of corroborative diagnostic analysis. In the case of an intentional infection, poisoning, or bioterrorism event, the resequencing pathogen detection microarray would allow for detailed strain identification that could be used to determine the possible originator of the event and to allow for rapid mitigation of the event (e.g. determination of infectious capacity, antimicrobial resistance, or engineered modifications to an organism) by implementing targeted public health containment measures directed by having the pathogen identified to the strain as the completed first step in the outbreak investigation process.

The present invention further suggests methods and processes to automate and optimize the iterative and adaptive design, fabrication and validation of arrays, including derivative sub-arrays. In a very preferable embodiment, an enterprise level, a consortium of experts on individual pathogens would maintain a web portal-enabled database. The consortium would maintain pathogen target sequences for identification and virulence.

The same technology described in the present invention can be used for non-clinical samples, including those collected from air, water, soil or surface swabs. The only modifications necessary to those described in the present invention will be those necessary for nucleic acid extraction and background nucleic acid removal, if a subtractive approach followed by generic amplification is a desired approach.

Multiple Pathogen Surveillance in a Population

The invention further provides a specific implementation that validates its capabilities in a real world operational setting. This implementation relates to epidemic outbreaks of acute respiratory disease involving common and less common etiologies, while simultaneously evaluating the possible presentation of hostile pathogenic agents (rare if ever) in individual encounters. Thus, the invention provides a means to perform near real time surveillance of a plurality of infectious pathogens involved in an infectious outbreak. Such surveillance may be validated and eventually become operational in a "real world testbed". In a preferred embodiment, the real world testbed is a human population that regularly encounters a variety of respiratory pathogens. In a preferred embodiment, the population is comprised of military personnel at an installation or base. In a very preferred embodiment, the population is comprised of active duty military personnel.

End User-Specified Applications

The integrated process of microarray design and assay will require only that sequences be provided to a microarray manufacturer and not involve the design of ancillary reagents (e.g. for specific PCR). Thus, an end user who has no detailed knowledge of genomics or would be capable of defining qualitative attributes of a microarray-based assay, and an automated bioinformatics pipeline would be used to select suitable target gene subsequences for submission to a resequencing microarray manufacturer. This would allow rapid deployment of a new microarray design for a specific geographic location, theater of operations. Thus, the integrated design/analysis capability that is enabled by the present invention will generalize to other envisioned applications besides those listed herein.

Adenovirus Sequences—

In an additional embodiment of the present invention are the genomic sequences of thirteen adenovirus strains, which were not known as of the date of the present invention. The thirteen adenovirus strains are: Ad3, Ad3FS_navy, Ad4, Ad4vaccine, Ad4FS_navy, Ad4FS_AF, Ad5FS, Ad7, Ad7FS_navy, Ad7 vaccine, Ad16, Ad1, and Ad21. These genomic sequences have been assigned the GenBank accession numbers shown in Table 6 appearing in the Examples. The full GenBank records, including partial annotation, for each of these sequences are found in the Sequence Listing attached herewith.

A "polypeptide" as used herein is understood to mean a sequence of several amino acid residues linked by peptide bonds. Such amino acids are known in the art and encompass the unmodified and modified amino acids. In addition, one or more modifications known in the art such as glycosylation, phosphorylation, etc may modify the polypeptide.

The term "isolated" means separated from its natural environment. This term is intended to also embrace the terms "purified" (100% pure) and "substantially purified" (at least 90% pure).

The term "polynucleotide" refers in general to polyribonucleotides and polydeoxyribonucleotides, and can denote an unmodified RNA or DNA or a modified RNA or DNA.

The term "homologous" as used herein is understood to mean sequence similarity between two or more polynucleotides or proteins from the same species or from a different species. Within the meaning of this term, said two or more polynucleotides (or proteins) are homologous when at least 70%, preferably at least 80%, most preferably at least 90% of the nucleotide base (amino acid) composition of a candidate sequence corresponds to the sequence according to the invention. According to the invention, a "homologous protein" is to be understood to retain at least 50%, preferably at least 75%, more preferably at least 85%, most preferably at least 95%, of the activity of the activity of the sequence of the present invention. As used herein "corresponds" is to be understood to mean that the corresponding amino acids are either identical or are mutually homologous amino acids. The expression "homologous amino acids" denotes those that have corresponding properties, particularly with regard to their charge, hydrophobic character, steric properties, etc. The same terminology can be used to describe DNA or RNA sequence homology for gene sequences that encode the corresponding proteins.

The term "homologous fragment" as used herein is understood to mean two or more polynucleotides or proteins from the same species or from a different species. In this context, it is contemplated that a fragment is homologous when it shares at least 400% identity to a fragment having at least 50 amino acids. Preferably, homologous fragments share at least 50% identity to a fragment having at least 50 amino acids. More preferably, homologous fragments share at least 60% identity, at least 70% identity, at least 80% identity, at least 90% identity, or at least 95% identity to a fragment having at least 50 amino acids. Accordingly, homologous fragments are included within the scope of the present invention. For homologous polynucleotides, it is understood that that the same homology ranges are envisioned in the present inventions but over a range of up to 1000 nucleotides, inclusive of all integers (i.e., 150, 250, 300, 500, 750, etc.).

Homology, sequence similarity or sequence identity of nucleotide or amino acid sequences may be determined conventionally by using known software or computer programs such as the BestFit or Gap pairwise comparison programs (GCG Wisconsin Package, Genetics Computer Group, 575 Science Drive, Madison, Wis. 53711). BestFit uses the local homology algorithm of Smith and Waterman, Advances in Applied Mathematics 2: 482-489 (1981), to find the best segment of identity or similarity between two sequences. Gap performs global alignments: all of one sequence with all of another similar sequence using the method of Needleman and Wunsch, J. Mol. Biol. 48:443-453 (1970). When using a sequence alignment program such as BestFit, to determine the degree of sequence homology, similarity or identity, the default setting may be used, or an appropriate scoring matrix may be selected to optimize identity, similarity or homology scores. Similarly, when using a program such as BestFit to determine sequence identity, similarity or homology between two different amino acid sequences, the default settings may be used, or an appropriate scoring matrix, such as blosum45 or blosum80, may be selected to optimize identity, similarity or homology scores.

The present invention also relates to polynucleotides that contain complete genes that are identified by open reading frames. Examples of the preferred genes embraced by the present invention include E1A, hexon, and fiber. The sequences of E1A, hexon, and fiber, as well as other preferred polynucleotide sequences within the scope of the present invention are found in the attached Sequence Listing. The present invention also embraces fragments of said genes and polynucleotides and fragments thereof that can be obtained by screening by means of the hybridization of a corresponding gene bank with a probe which contains the sequence of said polynucleotide or a fragment thereof, and isolation of said DNA sequence.

The present invention also relates to coding DNA sequences that result from degeneration of the genetic code. Moreover, one skilled in the art is also aware of conservative amino acid replacements such as the replacement of glycine by alanine or of aspartic acid by glutamic acid in proteins as "sense mutations" that do not result in any fundamental change in the activity of the protein, i.e. which are functionally neutral. It is also known that changes at the N- and/or C-terminus of a protein do not substantially impair the function thereof, and may even stabilize said function.

Polynucleotide sequences according to the invention are suitable as hybridization probes for RNA, cDNA and DNA, in order to isolate those cDNAs or genes, which exhibit a high degree of similarity to the probe sequence.

Polynucleotide sequences according to the invention are also suitable as primers for polymerase chain reaction (PCR) for the production of DNA that encodes an active enzyme.

Oligonucleotides such as these, which serve as probes or primers, can contain more than 30, preferably up to 30, more preferably up to 20, even more preferably at least 15, and most preferably at least 13 successive nucleotides. Oligonucleotides with a length of at least 40 or 50 nucleotides are also suitable.

Hybridization protocols are known in the art and are disclosed, for example, in Sambrook et al., Molecular Cloning: A Laboratory Manual, Cold Spring Harbor Laboratory, New York (1989). However, as used herein, stringent hybridization conditions are those conditions which allow hybridization between polynucleotides that are 75%, 80%, 85%, 90%, 95%, or 98% homologous as determined using conventional homology programs, an example of which is UWGCG sequence analysis program available from the University of Wisconsin (Devereux, Haeberli & Smithies, 1984). Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C.

Specificity is typically the function of post-hybridization washes, the critical factors being the ionic strength and temperature of the final wash solution. For DNA-DNA hybrids, the Tm can be approximated from the equation of Meinkoth and Wahl, (Meinkoth & Wahl, 1984): Tm=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The Tm is the temperature (under defined ionic strength and pH) at which 50% of a complementary target sequence hybridizes to a perfectly matched probe. Tm is reduced by about 1° C. for each 1% of mismatching; thus, Tm, hybridization and/or wash conditions can be adjusted to hybridize to sequences of the desired identity. For example, if sequences with approximately 90% identity are sought, the Tm can be decreased 10° C. Generally, stringent conditions are selected to be about 5° C. lower than the thermal melting point (Tm) for the specific sequence and its complement at a defined ionic strength and pH. However, severely stringent conditions can utilize a hybridization and/or wash at 1, 2, 3, or 4° C. lower than the thermal melting point (Tm); moderately stringent conditions can utilize a hybridization and/or wash at 6, 7, 8, 9, or 10° C. lower than the thermal melting point (Tm); low stringency conditions can utilize a hybridization and/or wash at 11, 12, 13, 14, 15, or 20° C. lower than the thermal melting point (Tm). Using the equation, hybridization and wash compositions, and desired Tm, those of ordinary skill will understand that variations in the stringency of hybridization and/or wash solutions are inherently described. If the desired degree of mismatching results in a Tm of less than 45° C. (aqueous solution) or 32° C. (formamide solution) it is preferred to increase the SSC concentration so that a higher temperature can be used. An extensive guide to the hybridization of nucleic acids is found in Current Protocols in Molecular Biology, Chapter 2, Ausubel, et al., Eds., Greene Publishing and Wiley-Interscience, New York (2000).

In this invention "primer" or "probe" means a polynucleotide, especially an oligonucleotide, that is produced synthetically or biologically and includes a specific nucleotide sequence and permits hybridization to a section containing the target nucleotide sequence.

Defined primers or probes, as well as all other oligonucleotides and polynucleotide of the present invention, may be produced by any of several well-known methods, including automated solid-phase chemical synthesis using cyanoethyl-phosphoramidite precursors. Other well-known methods for construction of synthetic primers/oligonucleotides may, of course, be employed. J. Sambrook, E. F. Fritsch and T. Maniatis, Molecular Cloning 11 (2d ed. 1989).

The primers used to amplify the sample nucleic acids may be coupled to a detectable moiety. A preferred example of such a detectable moiety is fluorescein, which is a standard label used in nucleic acid sequencing systems using laser light as a detection system. Other detectable labels can also be employed, however, including other fluorophores, radio labels, chemical couplers such as biotin which can be detected with streptavidin-linked enzymes, and epitope tags such as digoxigenin detected using antibodies. The primers may be modified whereby another nucleotide is added to, removed from, or substituted for at least one nucleotide in the oligonucleotide. Introduction of known labels such as radioactive substances, enzymes, fluorescence substances, etc. after synthesis of oligonucleotide is also included therein.

Similarly, the probes/oligonucleotides used to hybridize with the polynucleotides coding for the polypeptides of the invention, for example for the purpose of detection of such a polynucleotide, may be coupled to a detectable moiety.

As used herein, the term "enhancement" means increasing the intracellular activity of one or more enzymes in a plant cell and/or plant that are encoded by the corresponding DNA. Enhancement can be achieved with the aid of various manipulations of the bacterial cell. In order to achieve enhancement, particularly over-expression, the number of copies of the corresponding gene can be increased, a strong promoter can be used, or the promoter- and regulation region or the ribosome binding site which is situated upstream of the structural gene can be mutated. Expression cassettes that are incorporated upstream of the structural gene act in the same manner. In addition, it is possible to increase expression by employing inducible promoters. A gene can also be used which encodes a corresponding enzyme with a high activity. Expression can also be improved by measures for extending the life of the mRNA. Furthermore, preventing the degradation of the enzyme increases enzyme activity as a whole. Moreover, these measures can optionally be combined in any desired manner.

A gene can also be used that encodes a corresponding or variant enzyme with a high activity. Preferably the corresponding enzyme has a greater activity than the native form of the enzyme, more preferably at least in the range of 5, 10, 25% or 50% more activity, most preferably more than twice the activity of the native enzyme.

The above written description of the invention provides a manner and process of making and using it such that any person skilled in this art is enabled to make and use the same, this enablement being provided in particular for the subject matter of the appended claims, which make up a part of the original description.

As used herein, the phrases "selected from the group consisting of," "chosen from," and the like include mixtures of the specified materials.

Where a numerical limit or range is stated herein, the endpoints are included. Also, all values and sub-ranges within a numerical limit or range are specifically included as if explicitly written out.

The above description is presented to enable a person skilled in the art to make and use the invention, and is provided in the context of a particular application and its requirements. Various modifications to the preferred embodiments will be readily apparent to those skilled in the art, and the generic principles defined herein may be applied to other embodiments and applications without departing from the spirit and scope of the invention. Thus, this invention is not intended to be limited to the embodiments shown, but is to be accorded the widest scope consistent with the principles and features disclosed herein.

Having generally described this invention, a further understanding can be obtained by reference to certain specific examples, which are provided herein for purposes of illustration only, and are not intended to be limiting unless otherwise specified.

EXAMPLES

Materials and Methods

Table 6 (below) lists the adenovirus strains cited in the following examples. GenBank accession numbers refer to the genomic sequence numbers assigned to each strain. These sequences were not available to the public at the time of invention and form an embodiment of the present invention, as well as fragments of the same.

TABLE 6

| GenBank name | Accession no. | Genome size | Origin |
|---|---|---|---|
| Ad3 | AY599834 | 35,345 | ATCC#VR-3, strain GB |
| Ad3FS_navy | AY599836 | 35,265 | Ad3FS NHRC#1276 from NTC Great Lakes, IL Nov. 07, 1997 |
| Ad4 | AY594253 | 35,990 | ATCC#VR-4, strain RI-67 |
| Ad4vaccine | AY594254 | 35,994 | Calif. Public Health (via Kevin Russell/NHRC) |
| Ad4FS_navy | AY599835 | 35,965 | Ad4FS NHRC#42606 from Ft Jackson, SC Apr. 02, 2003 |
| Ad4FS_AF | AY599837 | 35,964 | Linda Canas, Brooks AFB, Lackland AFB AF#3 2002 |
| Ad5FS | AY601635 | 35,931 | Ad5FS NHRC#7151 from Ft Jackson, SC Jan. 06, 1998 |
| Ad7 | AY594255 | 35,305 | ATCC#AV-HAD7_AFIP, strain Gomen |
| Ad7FS_navy | AY601634 | 35,198 | Ad7FS NHRC#1315 from NTC Great Lakes, IL Nov. 19, 1997 |
| Ad7vaccine | AY594256 | 35,236 | NHRC vaccine tablet (Margaret Ryan, Kevin Russell/NHRC) |
| Ad16 | AY601636 | 35,522 | ATCC#VR-17, strain ch.79 |
| Ad1 | AF534906 | 36,001 | ATCC#VR-1, strain Adenoid 71 1953 |
| Ad21 | AY601633 | 35,382 | ATCC#NIAID V-221-002-014, NIH Research Reagent, prepared in November 1963 |

ATCC = American Type Culture Collection (Manassas, VA)
NHRC = Naval Health Research Center (San Diego, CA)
NIH = National Institutes of Health (Bethesda, MD)

The full GenBank records, including partial annotation, for each of these are found in the Sequence Listing attached herewith.

Influenza Content

The prototype influenza types represented by tiles on RPMV1 are:

Influenza A virus (A/New Caledonia/20/99) H1 HA gene for hemagglutinin 1

FluAHA3 Influenza A virus (A/Fujian/411/02) H3N2 gene for hemagglutinin 3

FluAHA5 Influenza A virus (A/HongKong/156/97/H5N1), hemagglutinin 5

FluANA1 Influenza (A/Chile/1/83), neuraminidase 1

FluANA2 Influenza A virus (A/Panama/2007/99/H3N2) NA gene for neuraminidase 2

FluAMATRIX Influenza virus A/NWS/33/H1N1 matrix protein (M)

FluBNA Influenza B virus (B/Yamagata/16/88), neuraminidase glycoprotein genes

FluBHA Influenza B virus (B/Yamanashi/166/98) hemagglutinin 1 subunit (HA)

FluBMATRIX Influenza B virus (B/Yamagata/16/88) M1 matrix protein (M)

The Accession numbers for each of the foregoing sequences, as well as the remaining pathogen target sequences, obtained from the public domain and personal communications, are listed in Table 9.

Preparation Example 1

RPM Version 1 Chip Design

DNA sequences were provided to Affymetrix for creation of the resequencing microarray chip (RPM Version 1 chip) utilized in the following examples. Submission of the DNA sequence and instruction files to Affymetrix were in accordance with the manufacturer instructions CustomSeq™ Array Protocol and product literature. Probe lengths were nominally 25-nucleotides long and contained a variable (interrogation point) central nucleotide for each of four possible variants (A, C, T or G) in both the sense and antisense directions.

The target genes selected for the RPMV1 pathogens listed above are described in the version 1 layout shown in Table 8 and the Sequence Listing along with the respective PCR primers used for amplification of the same. The sequences submitted for tiling and chip fabrication were based on the Affymetrix instruction file summarized in Table 7, which corresponds to the sequences appealing as SEQ ID NOs: 1-58. The corresponding "instruction file" lists the alias designator (e.g. FluAHA5) for each tile region and provides a "FASTA" formatted target gene sequence (this can be all or part of the complete target gene).

TABLE 7

RPMV1 Affymetrix instructions file for tiling and chip fabrication

| Name | Alias | Start | End | SEQ ID NO: | StartSeq | EndSeq | Design |
|---|---|---|---|---|---|---|---|
| FluAHA1 | FluAHA1 | 1 | 699 | 1 | TTGAGAAG | ATGGTATG | 1 |
| FluAHA3 | FluAHA3 | 1 | 794 | 2 | GATAGTGA | AAGCATTC | 1 |
| FluAHA5 | FluAHA5 | 1 | 524 | 3 | AATCCACT | GCTCCAAT | 1 |
| FluANA1 | FluANA1 | 1 | 1360 | 4 | AAAAGCAG | TTTTGTGG | 1 |
| FluANA2 | FluANA2 | 1 | 1449 | 5 | GCAAAAGC | TAGAAAAA | 1 |
| FluAMATRIX | FluAMATRIX | 1 | 923 | 6 | AGCAAAAG | TGCCAGAG | 1 |
| FluBHA | FluBHA | 1 | 684 | 7 | TTACATCC | AGCCATAG | 1 |
| FluBNA | FluBNA | 1 | 896 | 8 | ATGAACAA | CAGTTACA | 1 |
| FluBMATRIX | FluBMATRIX | 1 | 362 | 9 | ATGTCGCT | CATGAAAG | 1 |
| Ad4HEXON | Ad4HEXON-1 | 1 | 1096 | 10 | GTGGCGCC | TAAAGTTA | 1 |

TABLE 7-continued

RPMV1 Affymetrix instructions file for tiling and chip fabrication

| Name | Alias | Start | End | SEQ ID NO: | StartSeq | EndSeq | Design |
|---|---|---|---|---|---|---|---|
| Ad4HEXON | Ad4HEXON-2 | 2226 | 2504 | 10 | CGAGGTTA | GCCCACGC | 1 |
| Ad4FIBER | Ad4FIBER | 1 | 1258 | 11 | CGACCCCG | ACCCTGCA | 1 |
| Ad4E1A | Ad4E1A | 1 | 1326 | 12 | GCGGGGCA | CCCAGGCA | 1 |
| Ad5HEXON | Ad5HEXON-1 | 1 | 843 | 13 | GTGGCGCC | ATTGCTTT | 1 |
| Ad5HEXON | Ad5HEXON-2 | 1655 | 1846 | 13 | GACCTAAG | CCAACGTG | 1 |
| Ad5FIBER | Ad5FIBER | 1 | 2012 | 14 | TTCTGTCC | AGATCACC | 1 |
| Ad5E1A | Ad5E1A | 1 | 616 | 15 | AGCCGGAG | CTGTGGAA | 1 |
| Ad7HEXON | Ad7HEXON-1 | 1 | 807 | 16 | GTGGCGCC | ATTGGCTT | 1 |
| Ad7HEXON | Ad7HEXON-2 | 1652 | 2245 | 16 | TCTGTATG | AATTACAC | 1 |
| Ad7FIBER | Ad7FIBER | 1 | 712 | 17 | CCTTCAAC | AATGTTAA | 1 |
| Ad7E1A | Ad7E1A | 1 | 615 | 18 | AAGAGTTT | ACTGCCAC | 1 |
| PIVIHN | PIVIHN | 1 | 204 | 19 | TAGACCCA | TATAGGGA | 1 |
| PIVIIIHN | PIVIIIHN | 1 | 213 | 20 | CAAATCTA | TGAAAGAT | 1 |
| PIVIIINCFP | PIVIII5NCFP | 1 | 230 | 21 | ACTTAGGA | TTACAACC | 1 |
| HRV5NT | HRV5NT | 1 | 412 | 22 | GTCAAAGG | TCCTGTTT | 1 |
| RSVABL | RSVABL | 1 | 379 | 23 | AAGTGCTC | AAGCAAAC | 1 |
| RSVAN | RSVAN | 1 | 106 | 24 | AATACAAA | AGATAGTA | 1 |
| RSVBN | RSVBN | 1 | 128 | 25 | GGCAAATA | CAATTATG | 1 |
| WNVCPRM | WNVCPRM | 1 | 432 | 26 | GGCCAATA | TGATCCAG | 1 |
| WNVE | WNVE | 1 | 94 | 27 | ATTTGGCT | TTTGTGTG | 1 |
| WNVNS1 | WNVNS1 | 1 | 153 | 28 | GAAGCTTG | GGGTACAA | 1 |
| HCV229EMG | HCV229EMG | 1 | 598 | 29 | TAGAACAG | TAACCTAC | 1 |
| HCVOC43MG | HCVOC43MG | 1 | 358 | 30 | TGATTATT | TATATGAC | 1 |
| SPNLYTA | SPNLYTA | 1 | 125 | 31 | TATCGAAC | TCAGACC | 1 |
| SPNPLY | SPNPLY | 1 | 99 | 32 | GGTTTGGC | ATCAAGAT | 1 |
| SPYSPEB | SPYSPEB | 1 | 281 | 33 | AATCTTTT | TAGACATG | 1 |
| SPYMEFAE | SPYMEFAE | 1 | 370 | 34 | GGCAGGGC | TTACGAAA | 1 |
| SPYERMB | SPYERMB | 1 | 248 | 35 | AACTGATT | TAGAATCC | 1 |
| SPYERMTR | SPYERMTR | 1 | 176 | 36 | CAACGGGT | GATATTGT | 1 |
| MPP1 | MPP1 | 1 | 369 | 37 | AGGGGGTT | ACTATGTT | 1 |
| NMCTRA | NMCTRA | 1 | 135 | 38 | TTGGATGC | TTTTGCTG | 1 |
| NMCRGA | NMCRGA | 1 | 254 | 39 | GGTGCTGC | TGCCGGTC | 1 |
| BPPTXP | BPPTXP | 1 | 305 | 40 | GAAGTAGC | CAAACCGC | 1 |
| BPPTXS1 | BPPTXS1 | 1 | 222 | 41 | CGGCGCAT | AGGCCGAA | 1 |
| CPMOMPVD4 | CPMOMPVD4 | 1 | 150 | 42 | ATGCTGAT | TCAGATCA | 1 |
| CPMOMPVD2 | CPMOMPVD2 | 1 | 133 | 43 | AGCGTTCA | TAGGCGCT | 1 |
| CPRPOB | CPRPOB | 1 | 346 | 44 | AAGGACTT | CTGCAGGC | 1 |

TABLE 7-continued

RPMV1 Affymetrix instructions file for tiling and chip fabrication

| Name | Alias | Start | End | SEQ ID NO: | StartSeq | EndSeq | Design |
|---|---|---|---|---|---|---|---|
| BARPOB | BARPOB | 1 | 199 | 45 | CGTCCTGG | GGCAGAAG | 1 |
| BAPAGA | BAPAG | 1 | 354 | 46 | TAGCGGCG | TAATTCGT | 1 |
| BACAPB | BACAPB | 1 | 246 | 47 | TTACACGT | ACCTATTA | 1 |
| VMVHA | VMVHA | 1 | 510 | 48 | AACTATTA | TCACCAAC | 1 |
| VMVCRMB | VMVCRMB | 1 | 291 | 49 | TCGGGAAC | CGTCTGTT | 1 |
| ZEVL | ZEVL | 1 | 443 | 50 | TACTACCA | TCACACTG | 1 |
| LVGPC | LVGPC | 1 | 351 | 51 | GCGCACCG | GTGGGCAA | 1 |
| FTLP | FTLP | 1 | 431 | 52 | ATCGTAAT | TAAGTATG | 1 |
| FTFOPA | FTFOPA | 1 | 111 | 53 | CAGATATA | GATACTAC | 1 |
| YPCVE | YPCVE | 1 | 265 | 54 | ATAAAGGG | AGGCGGGG | 1 |
| YPCAF1 | YPCAF1 | 1 | 525 | 55 | TATGAAAA | ATATAGAT | 1 |
| ATTIM | ATTIM | 1 | 523 | 56 | ACATCGAC | GAGCTTGC | 1 |
| ATNAC1 | ATNAC1 | 1 | 543 | 57 | TATATGTA | ATTGTACA | 1 |
| Ad7HEXVAC | Ad7HEXVAC | 168 | 383 | 58 | GGTGCTTG | AAGCCCAT | 1 |

TABLE 8

RPMV1 layout, along with the respective PCR primers used for amplification of the same

| Organism | Gene Name | Amplicon | Probe | Gene found in SEQ ID NO: | Forward Primer (SEQ ID NO:) | Size | % GC |
|---|---|---|---|---|---|---|---|
| Influenza A | Hemaglutinin 1 | 675 | 699 | 1 | 439 | 23 | 47.8 |
| Influenza A | Hemaglutinin 3 | 770 | 794 | 2 | 440 | 24 | 33.3 |
| Influenza A | Hemaglutinin 5 | 500 | 524 | 3 | 441 | 26 | 42.3 |
| Influenza A | Hemaglutinin 5 | 219 | | | 442 | 26 | 30.8 |
| Influenza A | Neuraminidase 1 | 1336 | 1360 | 4 | 443 | 22 | 22.7 |
| Influenza A | Neuraminidase 2 | 1434 | 1449 | 5 | 444 | 22 | 45.5 |
| Influenza A | Matrix Gene | 911 | 923 | 6 | 445 | 20 | 40 |
| Influenza B | Hemaglutinin | 660 | 684 | 7 | 446 | 22 | 45.5 |
| Influenza B | Neuraminidase | 881 | 896 | 8 | 447 | 25 | 32 |
| Influenza B | Matrix Gene | 338 | 362 | 9 | 448 | 24 | 45.8 |
| Adenovirus 5 | Hexon | 819 | 843 | 13 | 449 | | |
| Adenovirus 5 | Hexon | 168 | 192 | 13 | 450 | 24 | 45.8 |
| Adenovirus 5 | Fiber | 1988 | 2012 | 14 | 451 | 22 | 45.5 |
| Adenovirus 5 | E1A | 171 | | | 452 | 24 | 54.2 |
| Adenovirus 5 | E1A | 431 | 616 | 15 | 453 | 23 | 56.5 |
| Adenovirus 4 | Hexon | 764 | 1096 | 10 | 454 | | |
| Adenovirus 4 | Hexon | 255 | 279 | 10 | 455 | 18 | 61.1 |
| Adenovirus 4 | Hexon | 511 | | | 456 | 19 | 57.1 |
| Adenovirus 4 | Fiber | 967 | | | 457 | 20 | 55 |
| Adenovirus 4 | Fiber | 435 | 1258 | 11 | 458 | | |
| Adenovirus 4 | E1A | 844 | | | 459 | 22 | 45.5 |
| Adenovirus 4 | E1A | 878 | | | 460 | 23 | 56.5 |
| Adenovirus 4 | E1A | 409 | 1326 | 12 | 461 | | |
| Adenovirus 7 | Hexon | 774 | 798 | 16 | 462 | | |
| Adenovirus 7 | Hexon | 570 | 594 | 16 | 463 | 24 | 61.6 |
| Adenovirus 7 | Fiber | 688 | 712 | 17 | 464 | 23 | 41.3 |
| Adenovirus 7 | E1A | 205 | | | 465 | 20 | 65 |
| Adenovirus 7 | E1A | 428 | 615 | 18 | 466 | | |
| Adenovirus 7 | Hexvac | | | | | | |
| Parainfluenza Virus I | HN | 180 | 204 | 19 | 467 | 27 | 48.1 |
| Parainfluenza Virus III | HN | 189 | 213 | 20 | 468 | 21 | 47.6 |

TABLE 8-continued

RPMV1 layout, along with the respective PCR primers used for amplification of the same

| | | | | | | | |
|---|---|---|---|---|---|---|---|
| Parainfluenza Virus III | 5' noncoding region of fusion protein | 206 | 230 | 21 | 469 | 21 | 38.1 |
| Human rhinovirus | 5' noncoding region | 388 | 412 | 22 | 470 | 16 | 56.2 |
| RSV (A, B) | L-polymerase major | 355 | 379 | 23 | 471 | 19 | 36.8 |
| RSV (A) | nucleocapsid, N major | 82 | 106 | 24 | 472 | 26 | 38.5 |
| RSV (B) | nucleocapsid, N | 104 | 128 | 25 | 473 | 26 | 38.5 |
| West Nile virus | C and prM | 408 | 432 | 26 | 474 | 25 | 48 |
| West Nile virus | E | 70 | 94 | 27 | 475 | 21 | 52.4 |
| West Nile virus | NS1 | 129 | 153 | 28 | 476 | 21 | 52.4 |
| Human coronavirus (229E) | membrane glycoprotein | 574 | 598 | 29 | 477 | 20 | 40 |
| Human coronavirus (OC43) | membrane glycoprotein | 334 | 358 | 30 | | 20 | 55 |
| Streptococcus pneumoniae | Autolysin, lytA | 101 | 125 | 31 | 478 | 21 | 47.6 |
| Streptococcus pneumoniae | pneumolysin, ply | 75 | 99 | 32 | 479 | 22 | 50 |
| Mycoplasma pneumoniae | Cytadhesin P1 protein | 345 | 369 | 37 | 480 | 24 | 58.3 |
| Neisseria meningitidis | capsular transport protein (ctrA) gene | 111 | 135 | 38 | 481 | 19 | 57.9 |
| Neisseria meningitidis | regularoty protein, crgA | 230 | 254 | 39 | 482 | 25 | 60 |
| Bordetella pertussis | Pertussis toxin promoter region | 281 | 305 | 40 | 483 | 22 | 72.7 |
| Bordetella pertussis | Pertussis toxin S1 subunit ptxS1 | 198 | 222 | 41 | 484 | 18 | 61.1 |
| Chlamydia pneumoniae | major outer membrane protein (MOMP) VD4 | 126 | 150 | 42 | 485 | 16 | 62.5 |
| Chlamydia pneumoniae | DNA directed RNA polymerase (rpoB) | 322 | 346 | 44 | 486 | 21 | 42.9 |
| Chlamydia pneumoniae | major outer membrane protein (MOMP) VD2 | 109 | 133 | 43 | 487 | 20 | 40 |
| Streptococcus pyogenes | pyrogenic exotoxin B (speB) | 257 | 281 | 33 | 488 | 20 | 50 |
| Streptococcus pyogenes | macrolide-efflux determinant (mefA, mefE) | 346 | 370 | 34 | 489 | 21 | 33.3 |
| Streptococcus pyogenes | erythromycin resistance methylase (ermB) | 224 | 248 | 35 | 490 | 23 | 39.1 |
| Streptococcus pyogenes | erm(TR) | 152 | 176 | 36 | 491 | 20 | 40 |
| Bacillus anthracis | RNA polymerase beta-subunit (rpoB) | 175 | 199 | 45 | 492 | 21 | 47.6 |
| Bacillus anthracis | protective antigen (pag) | 330 | 354 | 46 | 493 | 25 | 40 |
| Bacillus anthracis | Poly(D-glutamic acid) capsule (capB) | 222 | 246 | 47 | 494 | 19 | 52.6 |
| Variola Major Virus | hemagglutinin (HA) | 486 | 510 | 48 | 495 | 18 | 27.8 |
| Variola Major Virus | cytokine response modifier B (crmB) | 267 | 291 | 49 | 496 | 28 | 39.3 |
| Ebola Virus | L Gene | 419 | 443 | 50 | 497 | 22 | 27.3 |
| Lassa Virus | GPC Gene | 335 | 351 | 51 | 498 | 20 | 55 |

TABLE 8-continued

RPMV1 layout, along with the respective PCR primers used for amplification of the same

| | | | | | | | |
|---|---|---|---|---|---|---|---|
| *Francisella tularensis* | 13-kDa lipoprotein | 407 | 431 | 52 | 499 | 27 | 55 |
| *Francisella tularensis* | FopA | 87 | 111 | 53 | 500 | 27 | 37 |
| *Yersinia pestis* | cve2155 sequence | 242 | 265 | 54 | 501 | 22 | 54.5 |
| *Yersinia pestis* | Caf1 | 501 | 525 | 55 | 502 | 21 | 52.4 |
| *Arabisopsis thaliana* | T1M | 499 | 523 | 56 | 503 | 20 | 45 |
| *Arabisopsis thaliana* | NAC1 | 519 | 543 | 57 | 504 | 20 | 45 |
| | | | 29344 | | | | |

| Organism | Tm | Reverse Primer (SEQ ID NO:) | Size | % GC | Tm | Taqman Probe (SEQ ID NO:) | Size | % GC | Tm |
|---|---|---|---|---|---|---|---|---|---|
| Influenza A | 54.8 | 505 | 24 | 33.3 | 55.6 | | | | |
| Influenza A | 57.6 | 506 | 22 | 36.4 | 55.9 | | | | |
| Influenza A | 59.8 | 507 | 26 | 42.3 | 58.7 | | | | |
| Influenza A | 58.9 | 508 | 24 | 45.8 | 58.5 | | | | |
| Influenza A | 54.2 | 509 | 18 | 55.6 | 53.5 | | | | |
| Influenza A | 57.9 | 510 | 23 | 39.1 | 57.8 | | | | |
| Influenza A | 55 | 511 | | | | 571 | 20 | 55 | 62 |
| Influenza B | 55.5 | 512 | 24 | 47.9 | 57.5 | | | | |
| Influenza B | 56.3 | 513 | 22 | 45.5 | 56 | | | | |
| Influenza B | 59.9 | 514 | 25 | 36 | 59.6 | 572 | 22 | 54.5 | 63.4 |
| Adenovirus 5 | | 515 | | | | | | | |
| Adenovirus 5 | 57.6 | 516 | 24 | 54.2 | 58.5 | | | | |
| Adenovirus 5 | 55.9 | 517 | 20 | 60 | 61 | | | | |
| Adenovirus 5 | 61.5 | 518 | 21 | 66.7 | 61.3 | | | | |
| Adenovirus 5 | 59.7 | 519 | 21 | 57.1 | 57.3 | | | | |
| Adenovirus 4 | | 520 | | | | | | | |
| Adenovirus 4 | 63 | 521 | 18 | 66.7 | 62 | | | | |
| Adenovirus 4 | 66 | 522 | 18 | 50 | 64 | | | | |
| Adenovirus 4 | 57.8 | 523 | 21 | 47.6 | 54.9 | | | | |
| Adenovirus 4 | | 524 | | | | | | | |
| Adenovirus 4 | 57.1 | 525 | 19 | 59.9 | 59.6 | | | | |
| Adenovirus 4 | 61.2 | 526 | 25 | 48 | 60.6 | | | | |
| Adenovirus 4 | | | | | | | | | |
| Adenovirus 7 | | 527 | | | | | | | |
| Adenovirus 7 | 60.5 | 528 | 24 | 50 | 60.3 | | | | |
| Adenovirus 7 | 54.7 | 529 | 23 | 47.8 | 58.2 | | | | |
| Adenovirus 7 | 62 | 530 | 23 | 60.9 | 61.3 | | | | |
| Adenovirus 7 | | 531 | | | | | | | |
| Adenovirus 7 | | | | | | | | | |
| Parainfluenza Virus I | 62.8 | 532 | 28 | 35.7 | 58.2 | | | | |
| Parainfluenza Virus III | 48.5 | 533 | 21 | 42.9 | 49.5 | | | | |
| Parainfluenza Virus III | 46.3 | 534 | 20 | 40 | 48 | | | | |
| Human rhinovirus | 44.9 | 535 | 16 | 56.2 | 43.8 | | | | |
| RSV (A, B) | 43.9 | 536 | 19 | 36.8 | 42.9 | | | | |
| RSV (A) | 57.3 | 537 | 21 | 47.6 | 54.3 | | | | |
| RSV (B) | 58 | 538 | 30 | 33.3 | 59.1 | | | | |
| West Nile virus | 62.6 | 539 | 25 | 56 | 64.9 | | | | |
| West Nile virus | 53.8 | 540 | 21 | 52.4 | 53.8 | | | | |
| West Nile virus | 53.2 | 541 | 21 | 47.6 | 54.3 | | | | |
| Human coronavirus (229E) | 53.7 | 542 | 20 | 50 | 51.9 | | | | |
| Human coronavirus (OC43) | 55 | 543 | 20 | 45 | 53.7 | | | | |
| *Streptococcus* pneumoniae | 52.7 | 544 | 21 | 42.9 | 53.2 | | | | |
| *Streptococcus pneumoniae* | 56.3 | 545 | 23 | 43.5 | 58 | | | | |
| *Mycoplasma pneumoniae* | 63.8 | 546 | 25 | 52 | 60.8 | | | | |

TABLE 8-continued

RPMV1 layout, along with the respective PCR primers used for amplification of the same

| | | | | | |
|---|---|---|---|---|---|
| Neisseria meningitidis | 53.2 | 547 | 20 | 45 | 54.4 |
| Neisseria meningitidis | 73.6 | 548 | 24 | 62.5 | 69.4 |
| Bordetella pertussis | 69.6 | 549 | 20 | 55 | 59.1 |
| Bordetella pertussis | 56.2 | 550 | 19 | 63.2 | 58.6 |
| Chlamydia pneumoniae | 50.3 | 551 | 25 | 32 | 55.5 |
| Chlamydia pneumoniae | 52 | 552 | 20 | 50 | 49.2 |
| Chlamydia pneumoniae | 50.6 | 553 | 21 | 47.6 | 48.7 |
| Streptococcus pyogenes | 48.1 | 554 | 20 | 40 | 48.7 |
| Streptococcus pyogenes | 43 | 555 | 21 | 38.1 | 47.2 |
| Streptococcus pyogenes | 50.7 | 556 | 20 | 50 | 51.7 |
| Streptococcus pyogenes | 45.2 | 557 | 23 | 30.4 | 48.7 |
| Bacillus anthracis | 52.5 | 558 | 23 | 34.8 | 53.2 |
| Bacillus anthracis | 54.9 | 559 | 27 | 44.4 | 57.1 |
| Bacillus anthracis | 49 | 560 | 19 | 42.1 | 51.7 |
| Variola Major Virus | 48 | 561 | 23 | 34.8 | 48.3 |
| Variola Major Virus | 59.1 | 562 | 24 | 50 | 59.8 |
| Ebola Virus | 50.1 | 563 | 30 | 33.3 | 60.1 |
| Lassa Virus | 59.5 | 564 | 29 | 31 | 57.6 |
| Francisella tularensis | 59.5 | 565 | 24 | 31 | 57.6 |
| Francisella tularensis | 59.9 | 566 | 23 | 43.5 | 56 |
| Yersinia pestis | 60.1 | 567 | 20 | 65 | 61.8 |
| Yersinia pestis | 57.4 | 568 | 23 | 39.1 | 53.6 |
| Arabisopsis thaliana | 47.7 | 569 | 20 | 50 | 49.9 |
| Arabisopsis thaliana | 51.1 | 570 | 20 | 50 | 53.3 |

The instruction file references the same alias designators, but further specifies the actual subsequences that are actually to be tiled onto the array. In most cases, this represents the entire sequence from the sequence file but in others (e.g. FluBMATRIX) only nucleotides 1-362 of the total sequence were used for tiling. Table 9 provides the information presented in the instructions file, Table 9 (below): Instruction file (specific file) of the RPM V1 design specification. The alias designator is a name assigned to each discrete "tile" region (e.g. a geometric region of the microarray containing all probe combinations required for resequencing of a stretch of pathogen genome sequence). The pathogen, sequence accession number, and tile size for each tile region are shown. The instructions, which were processed in Affymetrix submission format, appear in Table 7. The instruction file references complete or partial sequence of the complete target genes that are found in SEQ ID NOs: 1-58 appearing in the attached Sequence Listing.

TABLE 9

RPMV1 Chip Table

| ALIAS | NAME | GENE_NAME | ACCESSION_NO | LENGTH |
|---|---|---|---|---|
| ATNAC1 | Arabidopsis thaliana | NAC1 | | 543 |
| ATTIM | Arabidopsis thaliana | TIM | | 523 |
| Ad4E1A | Adenovirus 4 | E1A | AF594253 (draft) | 1326 |
| Ad4FIBER | Adenovirus 4 | Fiber | AF594253 (draft) | 1258 |
| Ad4HEXON-1 | Adenovirus 4 | Hexon | AF594253 (draft) | 1096 |
| Ad4HEXON-2 | Adenovirus 4 | Hexon | AF594253 (draft) | 279 |
| Ad5E1A | Adenovirus 5 | E1A | AY147066 | 616 |
| Ad5FIBER | Adenovirus 5 | Fiber | M18369 | 2012 |
| Ad5HEXON-1 | Adenovirus 5 | Hexon | AF542130 | 843 |
| Ad5HEXON-2 | Adenovirus 5 | Hexon | AF542130 | 192 |

TABLE 9-continued

RPMV1 Chip Table

| ALIAS | NAME | GENE_NAME | ACCESSION_NO | LENGTH |
|---|---|---|---|---|
| Ad7E1A | Adenovirus 7 | E1A | AY594255 (draft) | 615 |
| Ad7FIBER | Adenovirus 7 | Fiber | AY594255 (draft) | 712 |
| Ad7HEXON-1 | Adenovirus 7 | Hexon | AY594255 (draft) | 807 |
| Ad7HEXON-2 | Adenovirus 7 | Hexon | AY594255 (draft) | 594 |
| Ad7HEXVAC | Adenovirus 7 | Hexon | AY594256 (draft) | 216 |
| BACAPB | *Bacillus anthracis* | Poly(D-glutamic acid) capsule (capB) | M24150 | 246 |
| BAPAG | *Bacillus anthracis* | protective antigen (pag) | M22589 | 354 |
| BARPOB | *Bacillus anthracis* | RNA polymerase beta-subunit (rpoB) | AF205323 | 199 |
| BPPTXP | *Bordetella pertussis* | Pertussis toxin promoter region | M13223 | 305 |
| BPPTXS1 | *Bordetella pertussis* | Pertussis toxin S1 subunit ptxS1 | M13223.1 | 222 |
| CPMOMPVD2 | *Chlamydia pneumoniae* | major outer membrane protein (MOMP) VD2 | CP0694 | 133 |
| CPMOMPVD4 | *Chlamydia pneumoniae* | major outer membrane protein (MOMP) VD4 | M69230 | 150 |
| CPRPOB | *Chlamydia pneumoniae* | DNA directed RNA polymerase (rpoB) | NT01CP0714 | 346 |
| FluAHA1 | Influenza A | Hemaglutinin 1 | AJ344014 | 699 |
| FluAHA3 | Influenza A | Hemaglutinin 3 | private communication | 794 |
| FluAHA5 | Influenza A | Hemaglutinin 5 | AF028709 | 524 |
| FluAMATRIX | Influenza A | Matrix Gene | L25814 | 923 |
| FluANA1 | Influenza A | Neuraminidase 1 | M24783 | 1360 |
| FluANA2 | Influenza A | Neuraminidase 2 | AJ457937 | 1449 |
| FluBHA | Influenza B | Hemaglutinin | AF100355 | 684 |
| FluBMATRIX | Influenza B | Matrix Gene | AF100378 | 362 |
| FluBNA | Influenza B | Neuraminidase | AY139081 | 896 |
| FTFOPA | *Francisella tularensis* | FopA | AF097542 | 111 |
| FTLP | *Francisella tularensis* | 13-kDa lipoprotein | M32059 | 431 |
| HCV229EMG | Human coronavirus (229E) | membrane glycoprotein | AF304460 | 598 |
| HCVOC43MG | Human coronavirus (OC43) | membrane glycoprotein | M93390 | 358 |
| HRV5NT | Human rhinovirus | 5' noncoding region | NC_001617 | 412 |
| LVGPC | Lassa Virus | GPC Gene | M15076 | 351 |
| MPP1 | *Mycoplasma pneumoniae* | Cytadhesin P1 protei | M18639 | 369 |
| NMCRGA | *Neisseria meningitidis* | regularoty protein, crgA | AF190471 | 254 |
| NMCTRA | *Neisseria meningitidis* | capsular transport potein (ctrA) | NMB0071 | 135 |
| PIVIHN | Parainfluenza Virus I | HN | U70948 | 204 |
| PIVIII5NCFP | Parainfluenza Virus III | 5' noncoding region | Z11575 | 213 |
| PIVIIIHN | Parainfluenza Virus III | HN | M18764 | 230 |
| RSVABL | RSV | L-polymerase | AF254574 | 379 |
| RSVAN | RSV A | major nucleocapsid, | M11486 | 106 |
| RSVBN | RSV B | major nucleocapsid, | D00736 | 128 |
| SPNLYTA | *Streptococcus pneumoniae* | Autolysin, lytA | SP1937 | 125 |
| SPNPLY | *Streptococcus pneumoniae* | pneumolysin, ply | SP1923 | 99 |
| SPYERMB | *Streptococcus pyogenes* | erythromycin resistance methylase (ermB) | X52632 | 248 |
| SPYERMTR | *Streptococcus pyogenes* | erm (TR) | AF002716 | 176 |
| SPYMEFAE | *Streptococcus pyogenes* | macrolide-efflux determinant (mefA, metE) | U70055 | 370 |
| SPYSPEB | *Streptococcus pyogenes* | pyrogenic exotoxin B (speB) | NT01SP1804 | 281 |
| VMVCRMB | Variola Major Virus | cytokine response mo | U88145 | 291 |
| VMVHA | Variola Major Virus | hemagglutinin (HA) | X65516 | 510 |
| WNVCPRM | West Nile virus | C and prM | AF196835 | 432 |
| WNVE | West Nile virus | E | AF196835 | 94 |
| WNVNS1 | West Nile virus | NS1 | AF196835 | 153 |
| YPCAF1 | *Yersinia pestis* | Caf1 | X61996 | 525 |
| YPCVE | *Yersinia pestis* | cve2155 sequence | AF350077 | 265 |
| ZEVL | Ebola Virus | L Gene | AF086833 | 443 |
| | | | | 29569 |

Figure 1:
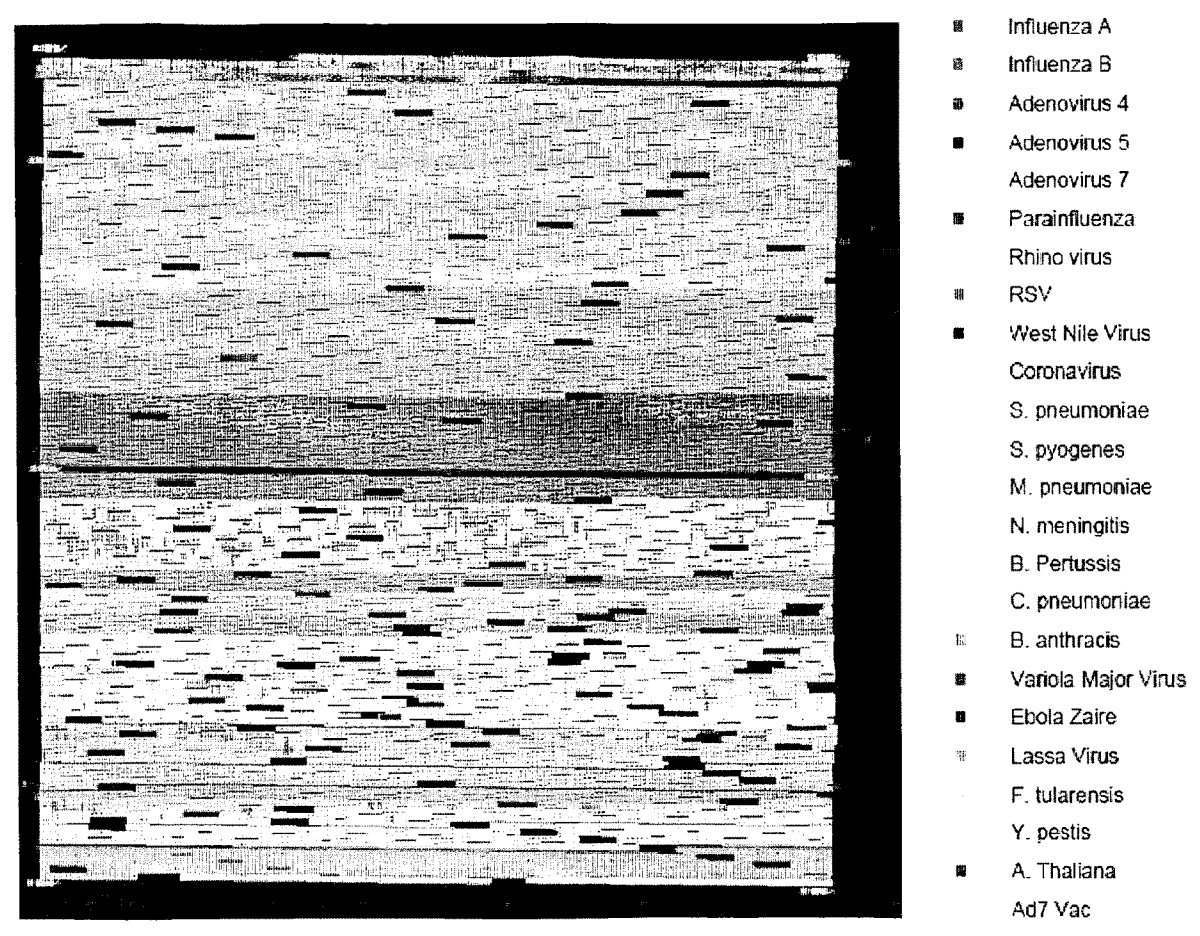

The chip design team at Affymetrix used the combination of the information above and the corresponding sequence file information to generate the layout of the chip. FIG. 1 shows an overview of the chip layout as a function of where the gene sequences for any given pathogen are clustered on the resequencing microarray chip (RPM Version 1 chip) utilized in the following examples. This figure and chip layout is only for illustration of the "real estate" allocation to various pathogens for the RPMV1 and is not intended to be limiting in any way. The skilled artisan would readily appreciate that the relative order and amounts of sequence dedicated to each of the pathogen clusters on this chip can be altered without intrinsic deleterious effects on the utility of the chip.

It is important to note that the tiling strategy dictates that the first 12 and last 12 sequences from each discrete tile region are not queried by the tiling strategy of the resequencing microarray, since they are used as components of the first and last 25-mer probes that are varied at the number 13 position.

The sequences used for the adenovirus regions (Ad4, Ad5, Ad7 and Ad7 vaccine) of the chip were all derived from early drafts of genomes sequenced by the present inventors. The GenBank submission files that correspond to the genomes used for tiled regions are listed in Table 6. Because the sequences submitted to Affymetrix for the prototypes were based on early drafts of the genomes, there were discrepancies observed between those early sequences and the final sequences submitted to Genbank. A list of those discrepancies is given in the Table 10:

TABLE 10

Discrepancies observed between the RPMV1 tiled sequences and the final sequences submitted to Genbank appearing in Table 6

| | Length of target | Sequence Base # | Target | Sequence |
|---|---|---|---|---|
| Contig for Ad4 | | | | |
| E1A | 2004 | 554 | missing | A |
| | | 658 | C | T |
| | | 697 | G | A |
| | | 698 | A | G |
| | | 851 | C | T |
| | | 1460 | C | T |
| | | 1675 | C | T |
| | | 1777 | A | G |
| | | 2002 | missing | T |
| Hexon | 2813 | 18319 | C | G |
| | | 18330 | missing | T |
| | | 18331 | missing | G |
| | | 18332 | missing | G |
| | | 18385 | A | G |
| | | 18451 | C | T |
| | | 18523 | T | C |
| | | 18547 | T | C |
| | | 18571 | C | T |
| | | 18586 | T | C |
| | | 18617 | T | C |
| | | 18640 | T | C |
| | | 18659 | G | T |
| | | 18662 | A | G |
| | | 18687 | T | C |
| | | 18700 | A | C |
| | | 18843 | A | G |
| | | 18889 | T | A |
| | | 18901 | C | T |
| | | 18940 | G | T |
| | | 18965 | A | C |
| | | 18997 | T | C |
| | | 19013 | G | A |
| | | 19020 | A | C |
| | | 19113 | A | C |
| | | 19237 | A | G |
| | | 19325 | T | C |
| | | 19327 | A | G |
| | | 19330 | C | T |
| | | 19447 | A | G |
| | | 19542 | C | A |
| | | 19714 | T | C |
| | | 19732 | A | C |
| | | 19759 | C | T |
| | | 19762 | A | G |
| | | 19765 | A | G |
| | | 19795 | C | A |
| | | 19796 | T | A |
| | | 19798 | C | T |
| | | 19816 | T | C |
| | | 19819 | C | T |
| | | 19881 | A | missing |
| | | 19897 | C | T |
| | | 19906 | C | T |
| | | 19911 | A | G |
| | | 19915 | T | C |
| | | 19916 | T | C |
| | | 19936 | T | C |
| | | 19976 | T | C |
| | | 20038 | C | T |
| | | 20050 | C | T |
| | | 20128 | C | C |
| | | 20149 | A | C |
| | | 20158 | A | C |
| | | 20176 | T | C |
| | | 20206 | C | G |
| | | 20210 | G | A |
| | | 20239 | missing | C |
| | | 20245 | C | missing |
| | | 20246 | T | A |
| | | 20285 | T | C |
| | | 20297 | T | C |
| | | 20336 | T | C |
| | | 20363 | T | C |
| | | 20366 | A | C |
| | | 20429 | T | C |
| | | 20435 | T | C |
| | | 20447 | G | C |
| | | 20459 | G | A |
| | | 20499 | T | C |
| | | 20511 | T | C |
| | | 20519 | T | C |
| | | 20528 | T | C |
| | | 20570 | T | C |
| | | 20579 | T | C |
| | | 20658 | C | G |
| | | 20660 | T | C |
| | | 20663 | T | C |
| | | 20666 | G | A |
| | | 20684 | T | C |
| | | 20687 | C | T |
| | | 20690 | T | A |
| | | 20713 | G | A |
| | | 20753 | T | C |
| | | 20759 | A | G |
| | | 20768 | C | T |
| | | 20819 | T | C |
| | | 20864 | T | C |
| | | 20939 | T | C |
| | | 21008 | C | T |
| | | 21038 | G | A |
| Fiber | 1386 | 31602 | missing | C |
| | | 31611 | missing | C |
| | | 31616 | missing | C |
| | | 31652 | missing | A |
| | | 31672 | G | missing |
| | | 31714 | missing | C |
| | | 31746 | T | missing |
| | | 31790 | missing | C |
| | | 31798 | C | missing |
| | | 31799 | C | missing |
| | | 31816 | missing | C |
| | | 31923 | T | missing |
| | | 31943 | C | missing |
| | | 32003 | G | missing |
| | | 32047 | T | missing |
| | | 32051 | missing | T |
| | | 32260 | T | missing |
| | | 32262 | G | T |
| | | 32266 | missing | G |
| | | 32473 | A | T |
| | | 32475 | T | A |
| | | 32618 | T | C |
| | | 32619 | C | T |
| | | 32934 | missing | C |
| Contig for Ad5_canji | | | | |
| E1A | 60 | none | | |
| Hexon | 60 | 19020 | G | missing |
| | | 19023 | A | missing |
| | | 19024 | C | missing |
| | | 19025 | A | missing |
| Fiber | 60 | none | | |
| Contig for Ad7 | | | | |
| E1A | 60 | none | | |

TABLE 10-continued

Discrepancies observed between the RPMV1 tiled sequences and the final sequences submitted to Genbank appearing in Table 6

| | Length of target | Sequence Base # | Target | Sequence |
|---|---|---|---|---|
| Hexon | 60 | none | | |
| Fiber | 60 | none | | |
| Contig for Ad7_Navy | | | | |
| E1A | 60 | 590 | C | T |
| Hexon | 60 | 18109 | A | G |
| Fiber | 60 | none | | |
| Contig for Ad7_Vaccine | | | | |
| E1A | 60 | 559 | C | G |
| | | 586 | C | T |
| Hexon | 60 | 18142 | A | G |
| Fiber | 60 | none | | |

This relatively small number of discordances did not interfere with the ability of the chip to make base calls that could be associated with the correct organism, except in one specific case of adenovirus type 4, described in the Examples. Overall, the resequencing microarray technique of the present invention corroborated the accurate (refined) final sequence of the tiled genes with respect to base substitutions, validating the unanticipated robustness of our method.

Preparation Example 2

PCR Primer Design and Amplification Protocols

Degenerate PCR Primers Design—

The objective of primer selection to support conserved (degenerate) multiplex PCR is to design primers that target the conserved regions flanking species-specific variable regions of E1A, fiber, and hexon genes. In general, this method may be applied to any organism, as conserved sequences within a species are a ubiquitous in nature. These target genes were selected based on their function and location within the linear adenoviral genome. E1A is located at the 5' end of the adenoviruses genome and encodes a trans-acting transcriptional regulatory factor that is necessary for transcriptional activation of early genes. The hexon and fiber genes, which are located in the middle and 3' end of the adenovirus genome, encode antigenic determinants ε and γ respectively, which determine the viral serotype. Thus, detection and serotyping of ARD-causing adenoviruses can be effectuated by targeting the nucleic acid determinants that give rise to the serotype. Thereby, the primers provided specific amplification within the adenovirus while the variable regions supplied serotype-specific characters for proper species identification.

The primers used for conserved (degenerate) multiplex PCR in the following examples are based on a global alignment of E1A, fiber, and hexon gene sequences, respectively, available from GenBank (GenBank accession numbers are given in parentheses): E1A-AdB (NC_004001), AdC (NC_001405), Ad3 (AF492352), Ad4 (M14918), Ad7 (X03000); fiber-Ad2 (AJ278921), Ad5 (M18369), Ad3 (X01998), Ad4 (X76547), Ad7 (M23696), Ad16 (U06106), Ad21 (U06107); hexon-Ad3 (X76549), Ad4 (X84646), Ad6 (AF161560, X67710, Y17245), Ad7 (AF053087, X76551), Ad16 (X74662), Ad21 (AB053166). The global sequence alignment for primer design of the E1A gene used the E1A gene sequences from Ad3, Ad4, Ad7, Ad21, AdB, and AdC serotypes. The global sequence alignment for primer design of the fiber gene used fiber gene sequences from Ad2, Ad3, Ad4, Ad5, Ad7, Ad16, and Ad21 serotypes. The global sequence alignment for primer design of the hexon gene used the hexon gene sequences from Ad3, Ad4, Ad6, Ad7, Ad16, and Ad21 serotypes.

Subsequent to the global sequence alignment, primer pairs were selected based on their ability to amplify E1A, fiber, and hexon genes of serotype 3, 4, 6, 7, 16 and 21 (data not shown). Table 11 shows the primer pairs employed in the following Examples.

TABLE 11

| Primer | Gene | Sequence (5' → 3') | Amplicon size (bp) |
|---|---|---|---|
| AdE1A-F | E1A | CGC TGC ACG ATC TGT ATG AT (SEQ ID NO: 421) | |
| AdE1A-R | E1A | TCT CAT ATA GCA AAG CGC ACA (SEQ ID NO: 422) | 409-446 |
| AdB1* | Fiber | TST ACC CYT ATG AAG ATG AAA GC (SEQ ID NO: 423) | |
| AdB2* | Fiber | GGA TAA GCT GTA GTR CTK GGC AT (SEQ ID NO: 424) | 670-772 |
| AdFib-F3 | Fiber | ACT GTA KCW GYT TTG GYT GT (SEQ ID NO: 425) | |
| AdFib-R3 | Fiber | TTA TTS YTG GGC WAT GTA KGA (SEQ ID NO: 426) | 430-437 |
| AdHex-F7 | Hexon | CAC GAY GTG ACC ACM GAC CG (SEQ ID NO: 427) | |
| AdHex-R5 | Hexon | TTK GGT CTG TTW GGC ATK GCY TG (SEQ ID NO: 428) | 770-815 |

Multiplex Degenerate Primer PCR Protocol—

The primers pairs (Lin et al., 2004) were evaluated in various multiplex combinations to obtain amplification of adenovirus serotype 3, 4, 6, 7, 16, and 21. PCR was performed in 50 µl volumes containing 20 mM Tris-HCl (pH 8.4), 50 mM KCl, 200 µM each of dNTPs, 200 nM AdB1, AdB2 primers; 300 nM AdE1A-F, AdE1A-R primers; 400 nM Adfib-F3, Adfib-R3 primers; 500 nM Adhex-F7, Adhex-R5 primers, 2 U of Platinum Taq DNA polymerase (Invitrogen), and $10^6$ copies of DNA templates. The amplification reaction was performed using a Peltier Thermal Cycler-PTC225 (MJ Research) with preliminary denaturation at 94° C. for 3 minutes, then followed by 40 cycles of denaturation at 94° C. for 30 seconds, annealing at 50° C. for 30 seconds, the extension at 72° C. for 40 seconds, and a final extension at 72° C. for 10 minutes. The generic multiplex PCR assay could amplify all three genes of all six ARD causing adenoviruses even though the hexon gene of Ad4 showed very weak band on agarose gel.

Total Amplification Protocol—

Total amplification was conducted using the commercially available GenomiPhi™ DNA Amplification Kit (Amersham Biosciences) to representatively amplify linear genomic DNA (hereinafter referred to as "GenomiPhi total amplification"). The amplification method employed in the GenomiPhi total amplification method utilizes bacteriophage Phi29 DNA polymerase enzyme to exponentially amplify single- or double-stranded linear DNA templates by strand displacement amplification. The starting sample was not quantified, but rather was used directly.

Preparation Example 3

REPI Software

Raw sequence data from the resequencing microarray chips is provided by the Genetic Data Analysis Software version 2.0 (GDAS) packaged with the microarray reader from Affymetrix. GDAS base calling is based on a previously described base-calling algorithm (Cutler et al., 2001). Each of the FASTA output files containing the base calls obtained from the GDAS software was analyzed using specialized software (REPI) that the present inventors developed.

In the case of the present invention, the sequence output of GDAS is most often a scattered mixture of contiguous sequence calls (A, T, C or G) that are interspersed with varying amounts of no-calls (n's) where the GDAS software does not make a base call due to lack of amplification, weak hybridization signal on the chip and/or high background hybridization caused by non-specific binding (Cutler et al., 2001). An example output of the GDAS output for the Adenovirus 4 prototype sample for the Ad4FIBER tile region is shown below (SEQ ID NO: 429):

```
>Ad4FIBER:CustemSeq-Adenovirus 4 Start = 12
End = 1245
nnnnnnnnnnnnnnncnnncncngaccgngnnnttcannaacnctcccnt cgnnctcttcagatgnattnnaagaaaagccctgggggtgttgtccnna nnnnnnngccgaccctgtcncnnnaagaatgnnnaaattannnnnaagct gngngagggggtnnnncttgacgactcgggaaaactcnttgcaancacag taaacaaggccattgcnnctctcagnttttnccaacaacaccatttnnnn ttaacatggatacccctttatacaccaaagntggaaaactanccttacaa gtttctnccaccattaagtatattaaaatcaacaattttgaatacnnnnn nnnnagcttttggntcaggtttnggactcagtnnnngcgcccnngcagta nanttagnctcnccacttacatttgntgataaagggaatanaaagattac ccnaaanagnnnnttgcatgttanaacaggagntgcaattgaaagcaaca tcagttgggctaaaggtntaaaattngaagatggtgccatagctacaaac attggtaannnnnnnnnnntnnnaaccagnngtncagaannannagnnan naangcttatccaatccaannnnnnnntgncnctggtctcagctttgaca gcacaggagccataatgnctggcaataaagnctatgataaattaactttg tggacaacgcctgacccatcaccaaactgncaaatncttgcagaaaatgn tgcaaaactaacactttgnnnnnnnnanngnnacagncaaatactggcca ctgtancngntttggntgttagaagnggaaacttaaacccaattactggc acagtaagcagtgctcaagntttcnncgntttgatgcaaatggtgnncn tntnacagaacactctanncnnaaaaaatnntggggcnanaagcaangag atagnatagatggcactccatacaccaatgctgttggttttatgccaaat tcaacagcttntnnaaagacncaaagttctnctnctaaaaataatntagt
```

-continued

```
gggtcaagtatacatgantnnagntgtttnanannncatgnttcttncta taactcttaatggtnctgatgacaccaccngtgcatnctcaatgncattt tcatacacctggactaacggaagctatatcggagcaacatttggagctaa ctcatacaccttctcntacatngcccannannnn
```

Similarity search algorithms such as BLAST (Korf et al., 2003) allow the use of n's (analogously to a wildcard) but the inclusion of too many n's results in an unacceptable degree of ambiguity. In that case, no meaningful BLAST results will be returned.

The REPI software was designed to parse the output of the FASTA file selecting and editing to mold sequence data into a format suitable for sequence similarity searches using the NCBI BLASTN algorithm. To accomplish this objective, REPI functions through a series of filters modifying the data as little as possible while extracting usable, "BLASTable" data from the FASTA files. Due to the nature of the resequencing microarray the sequences often contain large amounts of non-base calls (n's). BLAST is unable to return significant similarity for sequences with a large amount of non-base calls. Therefore the original sequences must be filtered to extract those portions that are most likely to return a significant similarity.

The first filter that a prospective sequence encounters is a control check. The control sequence incorporated into the microarray is specifically designed to be a nonsense sequence; therefore, it will never return a significant similarity. Next the sequence is evaluated for "BLASTable" data. Here a sliding window algorithm is used, the window-size parameter is entered by the user and represents the number of base calls the algorithm will evaluate at one time. The sequence is evaluated starting from the first base-call the window slides along the sequence searching for the first area containing relevant data, this is evaluated using a scoring method where all valid bases are given a score of one and all n's are given a score of zero. If the score is greater than or equal to a predetermined threshold (here 25% is used) the program marks the start of this window as the beginning of usable data. Once the start of usable data is determined the program reverses its parameters and begins searching for the end of the useable data, the score must now be less than or equal to the threshold. For each sequence REPI searches for the largest continuous string(s) of usable data, which will represent that sequence's initial subsequence.

This subsequence is then trimmed for beginning and trailing n's. Trimming is necessary because the previous filter uses the starting position of the starting window as the beginning of the subsequence and the last position of the ending window as the end of the subsequence, therefore all though that window's score was acceptable there may be n's leading or trailing the subsequence. The next filter the subsequence goes through is a length evaluation. Subsequences longer than 50 nucleotides are allowed to continue, subsequences shorter than 20 nucleotides are discarded, and subsequences between 20 and 50 nucleotides are re-evaluated as follows. Due to the length of these subsequences they are rescored using the same scoring system described earlier. Subsequences with greater than 60% non-base calls are discarded; all others are allowed to continue to be searched with the BLAST algorithm against GenBank, or one's own modified database.

Once the similarity search is complete REPI computes a number of statistics on the subsequence including the subsequence percentage of the target sequence, the subsequence length, the number of subsequence base calls, and the percentage of subsequence base calls. The subsequence percentage of the target sequence and the subsequence length shows what portion of the target pathogen gene was identified. The subsequence length and percentage of subsequence base calls allow us to monitor the filtering algorithm filters as well as the GDAS threshold parameters. REPI saves all statistical results returned from the BLASTN algorithm allowing the user to manipulate which results are displayed in the graphical user interface.

In the examples provided, REPI was interfaced to a local BLAST (NCBI GenBank) database (contained on an Apple G5 single processor (1.8 Ghz) computer with 4.5 GB of random access memory) via a CGI (Perl) interface. Displayed results included all database sequences within an expect value (E-value) threshold of 1.0e-9. The E-value represents the number of alignments expected at random given the size of the search space, the scoring matrix, and the gap penalties; the lower the E-value the less likely the database sequence similarity matches was in fact a random identification. By definition e=2.71828182845904523536028747135.

The REPI output is comprised of the (BLASTable) subsequence names, lengths, E-values, and bits scores are displayed for each subsequence in descending order of bit scores. The name is reported as the GenBank record's FASTA definition line and includes the sequence length. The score is the normalized score computed from the scoring matrix and gap penalties, the higher the score the greater the similarity.

The REPI output of the example listed above is shown below. For each "BLASTable" subsequence, REPI returns (in descending order of bit score ranking) all GenBank data records having expect values of <1.0 e-9. The highest bit score is achieved for the adenovirus 4 prototype (AY594253), which is genetically indistinguishable from the Ad4 vaccine strain (AY594254) across this stretch, while lower bit scores suitably distinguish field strains from Air Force and Navy training sites (SEQ ID NO: 430).

```
>Ad4FIBER:CustemSeq-Adenovirus 4 Start = 12
End = 1245
Subsequence:
cnnncncngaccgngnnnttcannaacnctcccntcgnnctcttcagatg nattnnaagaaaagcccctgggggtgttgtccnnannnnnnngccgaccc tgtcncnnnaagaatgnnnaaattannnnnaagctgngngagggggtnnn ncttgacgactcgggaaaactcnttgcaancacagtaaacaaggccattg cnnctctcagnttttnccaacaacaccatttnnnnttaacatggataccc ctttatacaccaaagntggaaaactanccttacaagtttctnccaccatt aagtatattaaaatcaacaattttgaatacnnnnnnnnnagcttttggnt caggtttnggactcagtnnnngcgcccnngcagtananttagnctcncca cttacatttgntgataaagggaatanaaagattacccnaaanagnnnntt gcatgttanaacaggagntgcaattgaaagcaacatcagttgggctaaag gtntaaaattngaagatggtgccatagctacaaacattggtaannnnnnn nnnntnnnaaccagnngtncagaannannagnnannaangcttatccaat ccaannnnnnnntgncnctggtctcagctttgacagcacaggagccataa tgnctggcaataaagnctatgataaattaactttgtggacaacgcctgac
``` ccatcaccaaactgncaaatncttgcagaaaatgntgcaaaactaacact ttgnnnnnnnnanngnnacagncaaatactggccactgtancngntttgg ntgttagaagnggaaacttaaacccaattactggcacagtaagcagtgct caagnttttcnncgntttgatgcaaatggtgnncntntnacagaacactc tanncnnaaaaaatnntggggcnanaagcaangagatagnatagatggca ctccatacaccaatgctgttggttttatgccaaattcaacagcttntnna aagacncaaagttctnctnctaaaaataatntagtgggtcaagtatacat gantnnagntgtttnanannncatgnttcttnctataactcttaatggtn ctgatgacaccaccngtgcatnctcaatgncattttcatacacctggact aacggaagctatatcggagcaacatttggagctaactcatacaccttctc ntacatngcccanna Subsequence Percentage of Target: 98%
Subsequence Length: 1215
Number of Subsequence Base Calls: 1020
Percentage of Subsequence Base Calls: 84%
lcl|AY594254|Human Adenovirus serotype 4, vaccine strain#|35,994 bp; Length=35994
   evalue: 0.0, score: 751.806 for Ad4FIBER
lcl|AY594253|Human Adenovirus Serotype 4|35,990 bp; Length=35990
   evalue: 0.0, score: 751.806 for Ad4FIBER
gi/303967|gb|L19194.1|ADRFIBERX Mastadenovirus h4 fiber protein, complete cds; Length=1346
   evalue: 0.0, score: 743.877 for Ad4FIBER
gi|22796371|emb|AJ315930.1|HAD315930 Human adenovirus type 4 DNA; Length=12718
   evalue: 0.0, score: 735.947 for Ad4FIBER
lcl|AY599837|Human Adenovirus serotype 4, USAF Field Strain|35,964 bp; Length=35964
   evalue: 0.0, score: 704.23 for Ad4FIBER
lcl|AY599835|Human Adenovirus serotype 4, US Navy Field Strain|35,965 bp; Length=35965
   evalue: 0.0, score: 696.3 for Ad4FIBER
gi|434913|emb|X76547.1|AV4FIB1 Adenovirus type 4 gene for fiber protein; Length=1375
   evalue: 2.32306E-154, score: 553.571 for Ad4FIBER
gi|7105037|gb|AF394196.1|AF394196 Simian adenovirus 25, complete genome; Length=36521
   evalue: 6.5072E-53, score: 216.57 for Ad4FIBER
gi|33694802|tpg|BK000413.1|TPA: Simian adenovirus 25, complete genome; Length=36519
   evalue: 6.5072E-53, score: 216.57 for Ad4 FIBER The application Java Archive (.jar) files for the REPI program are generated and processed in accordance with the description provided in U.S. Application Ser. No. 60/609,918 filed on Sep. 15, 2004, and U.S. Application Ser. No. 60/631,460, filed on Nov. 29, 2004, which are incorporated herein by reference in their entirety.

Example 1

Base Calling Algorithm Settings and BLAST Analysis of Base Calls for Adenovirus 4 Using Conserved (Degenerate) PCR Primers and GenomiPhi Total Amplification Raw sequence data from the resequencing microarray chips is provided by the Genetic Data Analysis Software version 2.0 (GDAS) packaged with the microarray reader from Affymetrix. GDAS base calling is based on a previously described base-calling algorithm, ABACUS, detailed previously (Cutler et al., 2001). A variety of base-calling algorithm parameters can be defined by the user (GDAS operators manual) to obtain a trade-off between base calling percentage and accuracy.

A description of the parameters is found in the GDAS manual on pages 207-217. The recommended (default) settings for GDAS are "conservative" settings that focus on the highest level of accuracy. In contrast, the objective of the present invention is to increase the percentage of base calls. To achieve this objective, the present inventors adjusted the parameters to allow highly permissive base calls (increased percentage) as listed below:

"Permissive" Base Calling Algorithm Settings—
Filter Conditions
  No Signal threshold=0.500 (default=1.000000)
  Weak Signal Fold threshold=20000.000 (default=20.000000)
  Large SNR threshold=20.000000 (default=20.000000)
Algorithm Parameters
  Strand Quality Threshold=0.000 (default=0.000000)
  Total Quality Threshold=25.0000 (default=75.000000)
  Maximum Fraction of Heterozygote Calls=0.99000 (default=0.900000)
  Model Type (0=Heterozygote, 1=Homozygote)=0
  Perfect Call Quality Threshold=0.500 (default=2.000000)
Final Reliability Rules
  Min Fraction of Calls in Neighboring Probes=1.0000 (disables filter)
  Min Fraction of Calls of Samples=1.0000 (disables filter)

The settings above are significant in the present application because the base call algorithm is set up by default to sacrifice the number of base calls made in order to make the most accurate calls (i.e., for SNP detection). In the present application, the technique is less concerned about achieving the same degree of accuracy as required for SNP detection but instead expanding the number of calls made so that the longest possible stretches of contiguous sequence are produced by GDAS, while maintaining specificity.

In a comparative approach to sample preparation for analysis by the RPM V1 microarray, a starting concentration of $10^6$ genomic copies of Adenovirus 4 prototype (AY594253) per microliter were amplified using either degenerate adenovirus PCR primers (Lin et al., 2004) or GenomiPhi isothermal methods. For the total amplification experiments, DNA was isolated from cultured adenoviruses and aliquoted at concentrations of $10^6$ copies per microliter. DNA was amplified using a total amplification strategy (GenomiPhi, Amersham), then processed in accordance with the standard Affymetrix CustomSeq™ protocol (available from manufacturer).

Figure 2B:
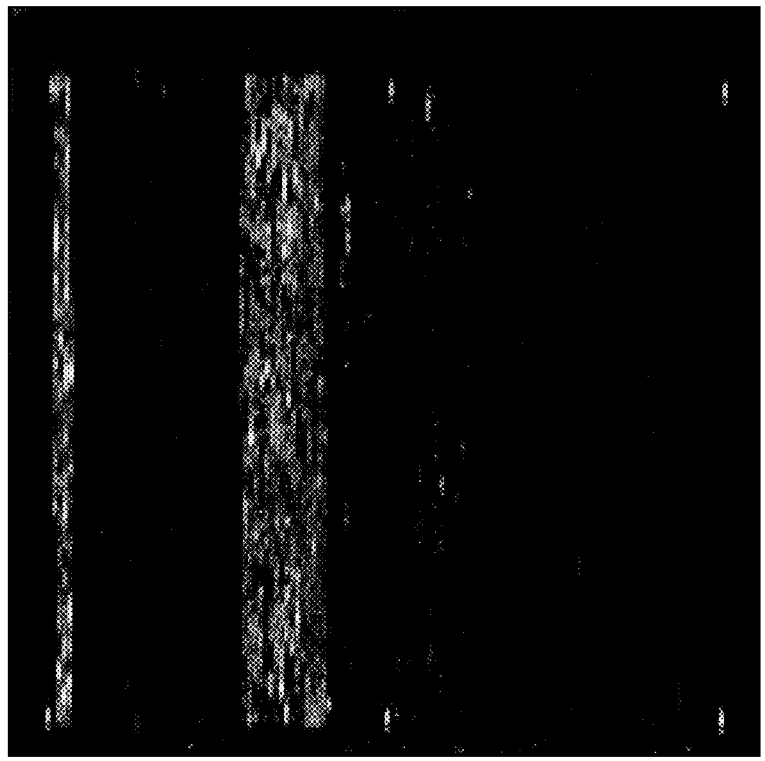
FIG. 2 shows purified adenovirus 4 prototype (accession number AY594253) DNA hybridization to RPMV1 following nucleic acid isolation and amplification using either (A) degenerate primer PCR (Lin et al., 2004) or (B) GenomiPhi total amplification of target DNA, as described in Example 1. Degenerate primer PCR (A) resulted in hybridization of targets within those tiled regions covered by conserved primer sites. Total amplification (B) resulted in target hybridization across the entire Ad4 tile regions. Neither method resulted in significant cross-hybridization across the microarray. In each case, REPI identified the correct strain of adenovirus 4 (AY594253) as having achieved the highest BLAST ("Basic Local Alignment Search Tool") bit score across all Ad4 tile regions where amplicons hybridized, except in one case (described in Example 1).
Figure 2A:
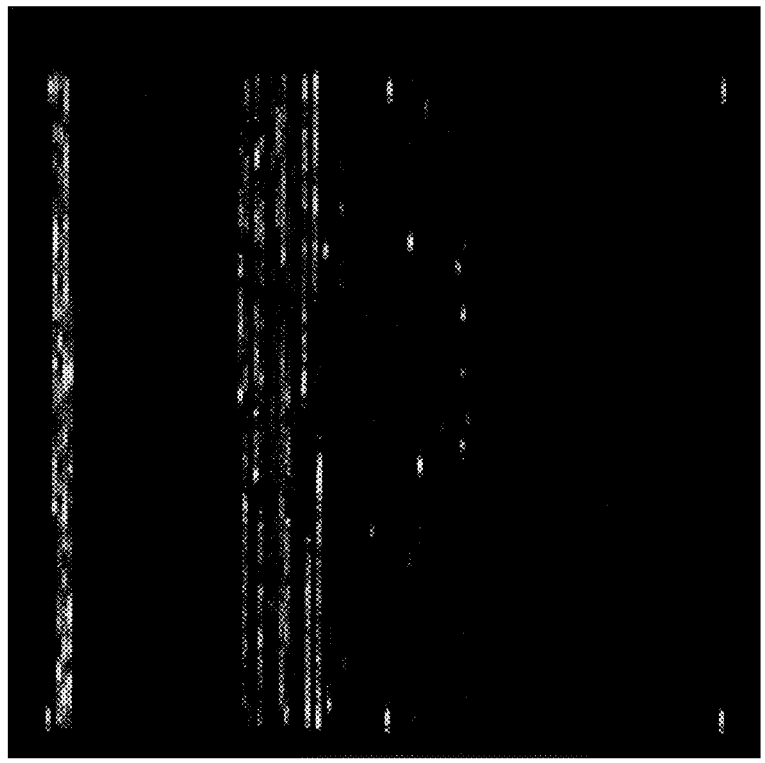

Images of the hybridized microarrays are shown in FIG. 2. GenomiPhi total amplification allowed the entire tiled region (increased sensitivity) to be resequenced compared to the more limited region resulting from conserved (degenerate) multiplex PCR. This result arises due to the fact that GenomiPhi total amplification does not rely on specific primer sequences within the tiled fragment. However, it is also important to note that irrespective of which amplification strategy was employed, i.e., conserved (degenerate) multiplex PCR or GenomiPhi total amplification, the proper Ad4 calls were made. The consistency between these methods is important as the conserved primers may have a more direct application to serotyping members of the same family of pathogens from complex samples without the need for selective enrichment.

Based on the corresponding GDAS outputs (using "permissive" settings), REPI identified the following list of top-ranked returns for the conserved PCR amplification strategy for the E1A, Fiber, and Hexon-1 tile regions of the V1 RPM microarray (note: omitted from this list are several adenovirus type 4 GenBank records having nearly identical sequences as the Ad4 prototype and Ad4 vaccine strain).

TABLE 12

Ad4E1A: CustemSeq-Adenovirus 4

| Accession # | Name | E value: | Bit Score: |
|---|---|---|---|
| AY594254 | Human Adenovirus serotype 4, vaccine strain | 1.04808E−107 | 396.964 |
| AY594253 | Human Adenovirus Serotype 4 | 1.04808E−107 | 396.964 |
| AY599837 | Human Adenovirus serotype 4, USAF Field Strain | 8.34268E−53 | 214.587 |
| AY599835 | Human Adenovirus serotype 4, US Navy Field Strain | 8.34268E−53 | 214.587 |

TABLE 13

Ad4FIBER: CustemSeq-Adenovirus 4

| Accession # | Name | E value: | Bit Score: |
|---|---|---|---|
| AY594254 | Human Adenovirus serotype 4, vaccine strain | 0.0 | 751.806 |
| AY594253 | Human Adenovirus Serotype 4 | 0.0 | 751.806 |
| AY599837 | Human Adenovirus serotype 4, USAF Field Strain | 0.0 | 704.23 |
| AY599835 | Human Adenovirus serotype 4, US Navy Field Strain | 0.0 | 696.3 |

TABLE 14

Ad4HEXON-1: CustemSeq-Adenovirus 4

| Accession # | Name | E value: | Bit Score: |
|---|---|---|---|
| AY594254 | Human Adenovirus serotype 4, vaccine strain | 0.0 | 751.806 |
| AY594253 | Human Adenovirus Serotype 4 | 0.0 | 751.806 |
| AY599835 | Human Adenovirus serotype 4, US Navy Field Strain | 1.73046E−169 | 603.13 |
| AY599837 | Human Adenovirus serotype 4, USAF Field Strain | 4.2185E−167 | 595.2 |

In each case shown above, the adenovirus type 4 prototype (AY594253) and vaccine strain (AY594254) returned the highest expect values and bit scores for hybridization of the adenovirus type 4 prototype amplicons obtained by conserved PCR amplification. This is expected because the prototype strain was used for vaccine production and the sequences were determined to be identical. In each case, the returns were distinguished in order of similarity from the closely related Air Force (AY599837) and Navy (AY599835) adenovirus 4 field strains.

Listed below are the corresponding outputs following GenomiPhi amplification of the adenovirus type 4 prototype instead of conserved PCR (note: not shown are several closely-related adenoviruses with bit scores higher than the Air Force and navy field strains):

TABLE 15

Ad4E1A: Adenovirus 4 GenomiPhi3

| Accession # | Name | E value: | Bit Score: |
|---|---|---|---|
| AY594253 | Human Adenovirus Serotype 4 | 0.0 | 868.765 |
| AY594254 | Human Adenovirus serotype 4, vaccine strain | 0.0 | 868.765 |
| gi\|209874\|gb\|M14918.1 | ADRDE1AA Adenovirus type 4 E1A region | 0.0 | 860.836 |

TABLE 16

Ad4FIBER: Adenovirus 4 GenomiPhi3

| Accession # | Name | E value: | Bit Score: |
|---|---|---|---|
| gi\|434913\|emb\|X76547.1 | AV4FIB1 Adenovirus type 4 gene for fiber protein | 0.0 | 1031.32 |
| AY594254 | Human Adenovirus serotype 4, vaccine strain | 0.0 | 926.254 |
| AY594253 | Human Adenovirus Serotype 4 | 0.0 | 926.254 |
| AY599837 | Human Adenovirus serotype 4, USAF Field Strain | 0.0 | 743.877 |

TABLE 17

Ad4HEXON-1: Adenovirus 4 GenomiPhi3

| Accession # | Name | E value: | Bit Score: |
|---|---|---|---|
| AY594254 | Human Adenovirus serotype 4, vaccine strain | 0.0 | 1065.02 |
| AY594253 | Human Adenovirus Serotype 4 | 0.0 | 1065.02 |
| gi\|11693508\|gb\|AF065062.2\|AF065062 | Human Adenovirus type 4 strain RI-67 pVI core protein | 0.0 | 1065.02 |
| AY599835 | Human Adenovirus serotype 4, US Navy Field Strain | 2.96209E−147 | 529.782 |

Based on the results evidenced by FIG. 2, GenomiPhi total amplification allowed the entire tiled region (increased sensitivity) to be resequenced compared to the more limited region resulting from conserved (degenerate) multiplex PCR. This result arises due to the fact that GenomiPhi total amplification does not rely on primer sequences within the tiled fragment. REPI listed the appropriate adenovirus type (AY594254 or AY594253) as the highest scoring return for each tile region with the exception of Ad4FIBER. This discrepancy was later resolved by observing that the early draft sequence of the adenovirus type 4 prototype (AY594253) contained errors that gave rise to a slightly higher homology between the sequence used to define Ad4FIBER and a GenBank record for a different adenovirus type 4 strain (gi\|11693508\|gb\|AF065062.2\|AF065062).

With this one exception, it is also important to note that irrespective of which amplification strategy was employed, i.e., conserved (degenerate) multiplex PCR or GenomiPhi total amplification, the proper Ad4 calls were made (except in case of Ad4FIBER with GenomiPhi due to tile sequence errors). The consistency between these methods is important as the conserved primers may have a more direct application to serotyping members of the same family of pathogens from complex samples without the need for selective enrichment.

Example 2

Ad4 Dilution Series

In the present example, hybridization and base calling was assayed as a function of the initial concentration of the target subsequent to conserved (degenerate) multiplex PCR. In addition, this example also compares two different base-calling strategies within the GDAS software: (a) "permissive" (described in Specification) and (b) "conservative" (default) settings. The biological sample utilized in this example was the adenovirus 4 prototype.

Hybridization and base calling were assayed as a function of the initial concentration of the target subsequent to conserved (degenerate) multiplex PCR. A dilution series of the adenovirus 4 prototype (ATCC) was prepared having $10^5$, $10^3$, and $10^1$ genomic copies per microliter. To this end, the Affymetrix CustomSeq protocol was followed, except that samples aliquoted from the aforementioned dilutions were amplified using the conserved (degenerate) multiplex adenovirus primer strategy for E1A, fiber, and hexon genes.

Tables 18-20 demonstrate the ability of the RPMV1 chip with REPI analysis to detect the appropriate Adenovirus type 4 target (not specific to strain) depending on whether "Conservative" (default GDAS) or "Permissive" (from Example 1) base call settings were used. A positive detection was counted when REPI returned one or more GenBank (or local) database record(s) for an Adenovirus type 4 target as the highest BLAST bit score value(s). In each case, "length" corresponds to the number of base pairs in the subsequence selected by REPI as having satisfied the conditions of the sliding window algorithm.

TABLE 18

Ad4 Fiber

| | Conservative | | | | | Permissive | | | | |
|---|---|---|---|---|---|---|---|---|---|---|
| Dilutions | Expt. | Score | Eval | name | length | Expt. | Score | Eval | name | length |
| $10^5$ | 1 | 835.065 | E−0.0 | Ad4 Fiber Protein | 1227 | 1 | 1623.97 | 0.0 | Ad4 Fiber Protein | 1227 |

TABLE 18-continued

Ad4 Fiber

| | | Conservative | | | | | Permissive | | | |
|---|---|---|---|---|---|---|---|---|---|---|
| Dilutions | Expt. | Score | Eval | name | length | Expt. | Score | Eval | name | length |
| $10^3$ | 1-2 | 1015.46 | E-0.0 | Ad4 Fiber Protein | 990 | 1-2 | 1447.89 | 0.0 | Ad 4 Fiber Protein | 997 |
| | 1-3 | 297.846 | E-78 | Ad4 Fiber Protein | 451 | 1-3 | 703.626 | 0.0 | Ad4 Fiber Protein | 512 |
| | 1-4 | 839.03 | 0.0 | Ad4 Fiber Protein | 1059 | 1-4 | 1605.08 | 0.0 | Ad4 Fiber Protein | 1215 |
| | 2 | 488.153 | E-134 | Ad4 Fiber Protein | 1208 | 2 | 1559.2 | 0.0 | Ad4 Fiber Protein | 1220 |
| | 2-2* | | n/d | — | — | 2-2 | | n/d | — | — |
| | 2-3 | 232.429 | E-58 | Ad4 Fiber Protein | 421 | 2-3 | 405.389 | E-110 | Ad4 Fiber Protein | 444 |
| $10^1$ | 2-4 | | n/d | — | — | 2-4 | | n/d | — | — |
| | 3 | 172.958 | E-40 | Ad4 Fiber Protein | 294 | 3 | 301.101 | E-79 | Ad4 Fiber Protein | 442 |
| | 3-2* | | n/d | — | — | 3-2 | | n/d | — | — |
| | 3-3 | | n/d | — | — | 3-3 | 118.758 | E-24 | Ad4 Fiber Protein | 279 |
| | 3-4 | 99.61 | E-19 | Ad4 Fiber Protein | 93 | 3-4 | 116.39 | E-24 | Ad4 Fiber Protein | 95 |

*indicates degraded template;
n/d indicates "not determined" due to insufficient base calls

TABLE 19

Ad4 E1A

| | | Conservative | | | | | Permissive | | | |
|---|---|---|---|---|---|---|---|---|---|---|
| Dilutions | Expt. | Score | E-val | name | length | Expt. | Score | Eval | name | length |
| $10^5$ | 1 | 448.5 | E-123 | Ad4 E1A region | 553 | 1 | 775.595 | E-0.0 | Ad4 E1A region | 556 |
| | 1-2 | 420.8 | E-115 | Ad4 E1A region | 422 | 1-2 | 691.471 | E-0.0 | Ad4 E1A region | 444 |
| | 1-3 | | n/d | — | — | 1-3 | 561.5 | E-157 | Ad4 E1A region | 413 |
| | 1-4 | 353.4 | E-94 | Ad4 E1A region | 424 | 1-4 | 589.253 | 165 | Ad4 E1A region | 424 |
| $10^3$ | 2 | 341.5 | E-91 | Ad4 E1A region | 399 | 2 | 607.1 | E-171 | Ad4 E1A region | 412 |
| | 2-2* | | n/d | — | — | 2-2 | | n/d | — | — |
| | 2-3 | 194.8 | E-47 | Ad4 E1A region | 404 | 2-3 | 470.774 | E-130 | Ad4 E1A region | 421 |
| | 2-4 | | n/d | — | — | 2-4 | | n/d | — | — |
| $10^1$ | 3 | | n/d | — | — | 3 | 385.836 | E-104 | Ad4 E1A region | 405 |
| | 3-2* | | n/d | — | — | 3-2 | | n/d | — | — |
| | 3-3 | | n/d | — | — | 3-3 | 199.58 | E-48 | Ad4 E1A region | 403 |
| | 3-4 | 412.8 | E-112 | Ad4 E1A region | 397 | 3-4 | 640.794 | E-0.0 | Ad4 E1A region | 398 |

TABLE 20

Ad4 Hexon

| | | Conservative | | | | | Permissive | | | |
|---|---|---|---|---|---|---|---|---|---|---|
| Dilutions | Expt. | Score | Eval | name | length | Expt. | Score | Eval | name | length |
| $10^5$ | 1 | 377.1 | E-101 | Ad4 Hexon gene | 760 | 1 | 893.45 | 0.0 | Ad4 Hexon gene | 769 |
| | 1-2 | 603.13 | E-0.0 | Ad4 Hexon gene | 760 | 1-2 | 941.874 | E-0.0 | Ad4 Hexon gene | 768 |
| | 1-3 | 107.5 | E-21 | Ad4 Hexon gene | 262 | 1-3 | 246.762 | E-62 | Ad4 Hexon gene | 497 |
| | 1-4 | 498.1 | E-138 | Ad4 Hexon gene | 760 | 1-4 | 920.916 | E-0.0 | Ad4 Hexon gene | 762 |
| $10^3$ | 2 | 383.1 | E-103 | Ad4 Hexon gene | 759 | 2 | 826.865 | E-0.0 | Ad4 Hexon gene | 759 |
| | 2-2* | | n/d | — | — | 2-2 | | n/d | — | — |
| | 2-3 | | n/d | — | — | 2-3 | | n/d | — | — |
| | 2-4 | | n/d | — | — | 2-4 | | n/d | — | — |
| $10^1$ | 3 | | n/d | — | — | 3 | 78.8677 | E-12 | Ad4 Hexon gene | 143 |
| | 3-2* | 71.86 | E-11 | Ad4 Hexon gene | 65 | 3-2 | 107.54 | E-21 | Ad4 Hexon gene | 72 |
| | 3-3 | | n/d | — | — | 3-3 | | n/d | — | — |
| | 3-4 | | n/d | — | — | 3-4 | 149.17 | E-33 | Ad4 Hexon gene | 209 |

*indicates degraded template;
n/d indicates "not determined" due to insufficient base calls Across the range of dilutions, the "Permissive" base call settings produced GDAS outputs that were used by REPI to consistently yield higher subsequence lengths and bit scores than those outputs using the default GDAS base call settings for SNP detection. In several cases, the "Permissive" base call settings resulted in a sufficient number of base calls for REPI to detect the target whereas the default settings did not. This example demonstrates that by lowering the restrictions on base calling by GDAS and coupling the output to the REPI algorithm, higher sensitivity and discriminatory power (strain identification) among pathogens is achieved.

Of particular note here is that in some cases, there was evidence contained in the image, GDAS output, and REPI analyses, of unintentional contamination of the degenerate primer cocktail with trace amounts of Adenovirus 7 and Adenovirus 5 (confirmed by specific real-time PCR). Because there was no significant cross-hybridization between the tile regions for the prototype adenoviruses, this contamination did not result in a perturbation of the base calling or results in the Adenovirus 4 tile regions. This demonstrates the robustness of the methods described herein to perform quantitative separation of mixtures of closely related pathogens.

It is noteworthy that the Andersen group at Lawrence Livermore National Laboratory (Wilson et al., 2002b) described the use of an Affymetrix resequencing chip that could detect a low concentration (~$10^1$ copies) following specific PCR amplification. However, it was not disclosed or suggested how this sensitivity was defined or to what extent those results were influenced by hybridization of closely related microbial species. Rather, the emphasis in that paper was the percentage of probe pairs that could be used, not the actual sequences as they were called by the chip. Therefore, the artisan would not have any expectation resulting from the disclosure. Nor would the skilled artisan have inferred this possibility form the previous patent (U.S. Pat. No. 6,228,575) or related publication (Gingeras et al., 1998) since these references fail to disclose or suggest robustness of the prescribed methods of pattern recognition to concentration differences, errors in the definition of tile region sequences, or other forms of interference.

Example 3

Figure 3A:
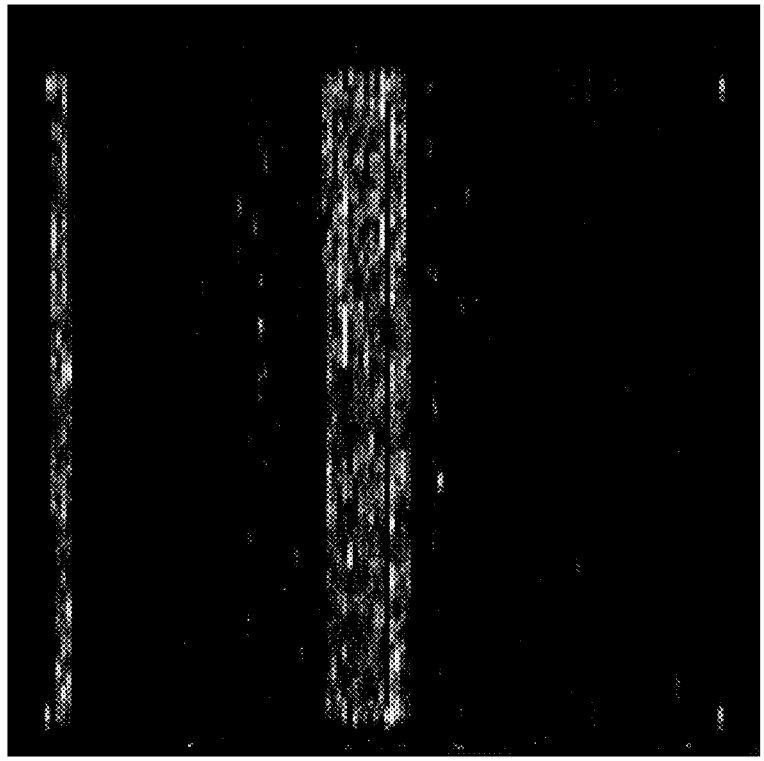
FIG. 3 shows purified adenovirus 5 field strain (Ad5FS, accession number AY601635) (A, B) and adenovirus 7 prototype (accession number AY594255) (C, D) DNA hybridizations to RPMV1 following nucleic acid isolation and amplification using either (A, C) degenerate primer PCR (Lin et al., 2004) or (B, D) GenomiPhi total amplification of target DNA as described in Example 3. Degenerate primer PCR (A, C) resulted in hybridization of targets within those tiled regions having conserved primer sites for both the Ad5FS and the Ad7 prototype. Total amplification (B, D) resulted in target hybridization across the entire Ad5 and Ad7 tile regions. Neither method resulted in significant cross-hybridization across the microarray. In each case, REPI identified the correct strain of adenovirus 5 (Ad5FS, accession number AY601635) or adenovirus 7 (accession number AY594255) as having achieved the highest BLAST bit score across all respective tile regions where amplicons hybridized. For adenovirus 7, the correct assignment was also made for the Ad7 prototype on the Ad7 vaccine tile region, distinguishing it correctly from Ad7 vaccine strain (AY594256) from which the tile region was derived. Also, it is noteworthy to mention that the degenerate primer solution used for amplification of all adenoviruses herein was unintentionally contaminated with small amounts of Ad4 and Ad7 prototypes (not considered positive for contamination by real-time PCR). The contaminants did not result in easily discernible hybridizations (as shown in FIG. 3) but base calls were made by Genetic Data Analysis Software (GDAS) (packaged with the microarray reader form Affymetrix, Santa Clara, Calif.) and Resequencing Pathogen Identifier (REPI) assigned all unintentional base calls to the correct contaminant. The GenomiPhi solution did not become contaminated, and no base calls were made on adenovirus tile regions outside of the Ad5 and Ad7 tile regions in respective experiments.
Figure 3B:
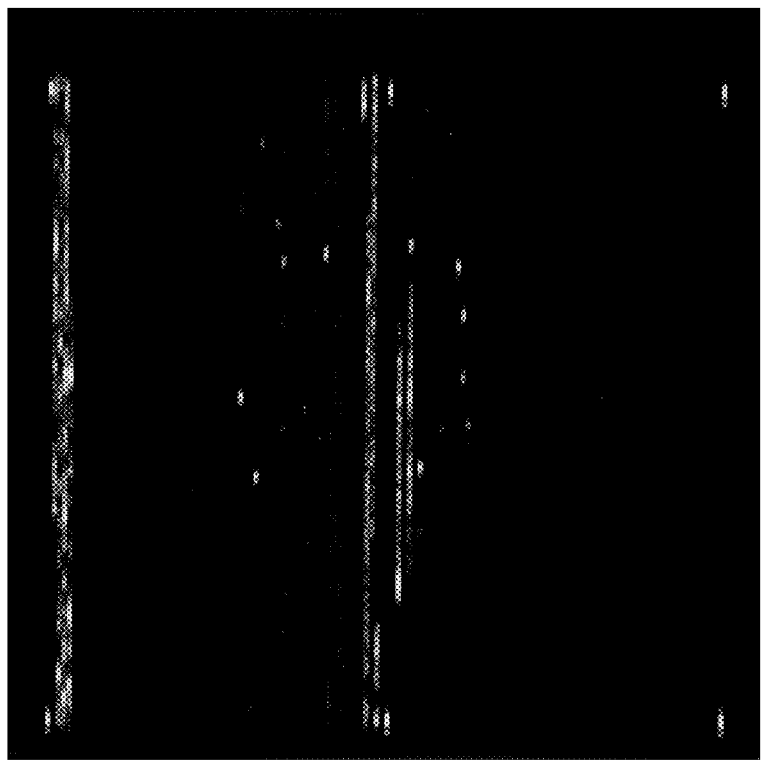

Base Calling Algorithm Settings and BLAST Analysis of Base Calls for Adenovirus 5 Field Strain (Ad5FS; AY601635) and Adenovirus 7 Prototype (Ad7; AY594255) Using Conserved (Degenerate) PCR Primers and GenomiPhi Total Amplification This example is the same as Example 1, except the resequencing microarray chip (RPMV1) described above in Preparation Example 1 was probed with adenovirus type 5 field strain (Ad5FS; AY601635) or adenovirus type 7 prototype (AY594255) using either (a) conserved (degenerate) multiplex PCR or (b) GenomiPhi total amplification (FIG. 3). Based on the GDAS outputs (using "permissive" settings), REPI identified the following 3 top "hits" for the conserved PCR and total amplification strategies with each of the Ad5 prototype and the Ad7 prototype. Without exception, each subsequence called by the adenovirus type 5 tile regions (Ad5E1A, Ad5FIBER, Ad5FIBER, Ad5HEXON-1 and Ad51HEXON-2) listed the top "hit" (highest BLAST bit score) as the correct prototype strain for adenovirus type 5 (Ad5FS; Accession number AY601635) using either conserved PCR amplification or total (GenomiPhi) amplification.

Also, without exception, each subsequence for the adenovirus type 7 tile regions (Ad7E1A, Ad7FIBER, Ad5HEXON-1 and Ad5HEXON-2) listed the top "hit" (highest BLAST bit score) as the correct prototype strain for adenovirus type 7 (Ad7; Accession number AY594255) when using either conserved PCR or total (GenomiPhi) amplification. In addition, GenomiPhi amplification led to base calls from both the Ad4E1A regions and the Ad7vaccine regions, both resulting in top bit scores assigned to the correct Ad7 prototype strain.

The results obtained for the adenovirus type 5 and adenovirus type 7 prototypes confirmed those for adenovirus type 4. Specifically, the results shown in FIGS. 3A-D show that GenomiPhi total amplification allowed the entire tiled region (increased sensitivity) to be resequenced compared to the more limited region resulting from conserved (degenerate) multiplex PCR. More importantly, these results confirm that irrespective of which amplification strategy was employed, i.e., conserved (degenerate) multiplex PCR or GenomiPhi total amplification, the proper Ad5 or Ad7 calls were made.

Example 4

Ad4-5 Breakthrough Strain as a Model of Mixed Infection Detectable by Resequencing Microarray Assay The sample for this example was provided by the Naval Health Research Center (San Diego). The archived sample was a nasal wash from a basic trainee who had previously been immunized for adenovirus (using the Ad4/Ad7 vaccine) and who subsequently was diagnosed with adenovirus infection and febrile respiratory illness. Strains associated with infection in spite of previous vaccination are broadly referred to as "breakthrough strains". In this case, the presumption was that a single variant form of adenovirus was the causative agent. The sample described here is referred to as Ad4-5 Breakthrough because of inconclusive culture and serological assays that indicated properties of both adenovirus types 4, while sequencing of the hexon gene (one of antigenic determinants of adenovirus serotype) indicated properties of adenovirus type 5.

The sample was processed according to the multiplex degenerate primer PCR protocol described in Preparation Example 1. This approach was demonstrated to (Lin et al 2004) successfully amplify hypervariable regions on hexon and fiber genes (as well as a relatively variable E1A region) for all adenoviruses associated with febrile respiratory infection. Otherwise, the standard Affymetrix CustomSeq protocol was used.

Figure 4:
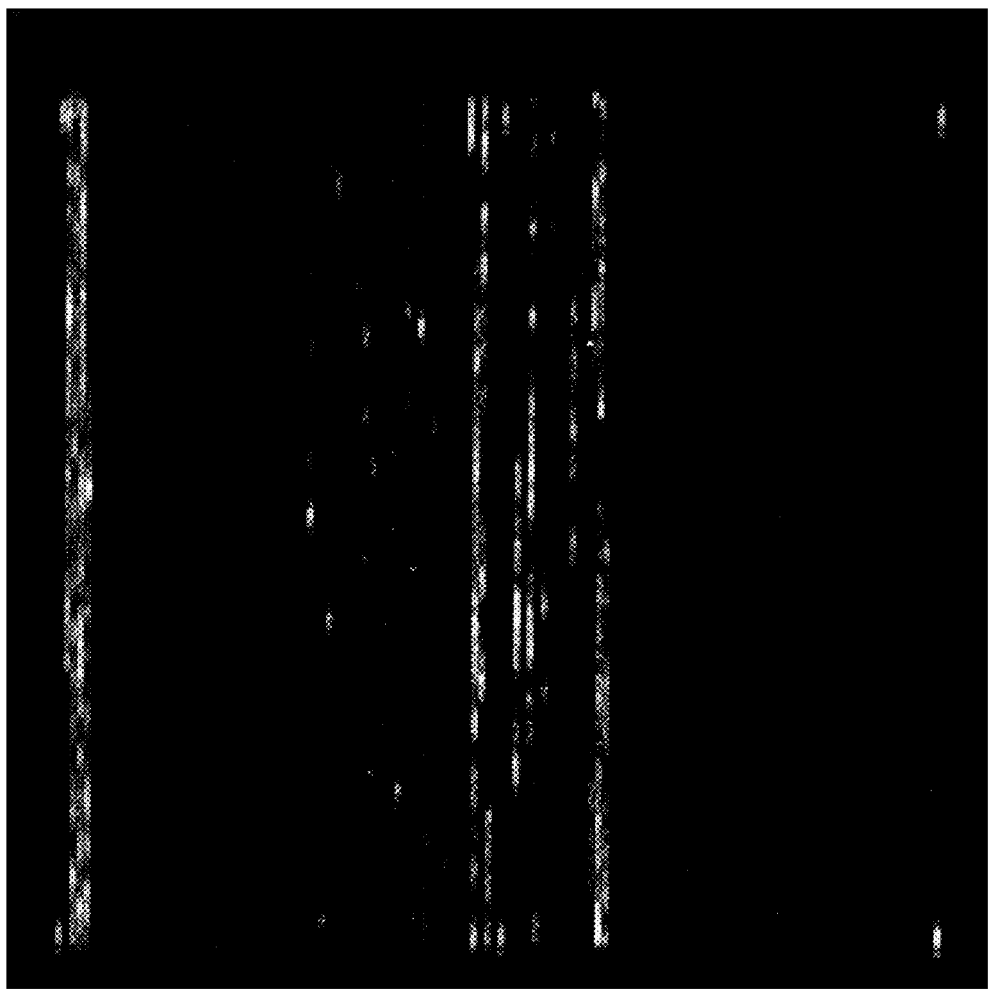
FIG. 4 shows the results of the adenovirus 4,5 breakthrough strain as described in Example 4. An aliquot of purified nucleic acid from culture of throat swab of a patient with febrile respiratory illness (who was previously vaccinated against adenovirus) was amplified using conserved/degenerate primers as described (Lin et al., 2004) and otherwise processed according to the standard Affymetrix CustomSeq protocol. The patient was diagnosed as Ad4 positive via serotypic antibody neutralization, and diagnosed as Ad5 positive via a hexon sequence. The present inventors obtained multiple target hybridizations, resulting in base calls on all the adenovirus 5 and adenovirus 7 prototype tile regions. REPI analysis revealed that the adenovirus was identified with high confidence as Ad5 (Ad5FS, accession number AY601635), while multiple Ad7 prototype regions gave evidence of a B subgroup species other than Ad7, namely Ad21. It is noteworthy again to note that the degenerate primer solution, used for amplification of all adenoviruses herein was unintentionally contaminated with small amounts of Ad4 and Ad7 prototypes, as in the case shown in FIG. 3. The contaminants did not result in easily discernible hybridizations in the Ad4 tiles (as shown in FIG. 4) but base calls were made by GDAS and REPI assigned all unintentional base calls to the correct contaminant (adenovirus 4 prototype; accession number AY594253), not a field strain that circulates in basic military training venues. Moreover, the highest bit score achieved in the Ad7 tiles was not Ad7 prototype (despite low-level contamination) but adenovirus type 21 (Ad 21; AY601633), another member of the B subgroup of adenoviruses represented by the Ad7 prototype (AY594255). The observation of a mixture of Ad5 and Ad21 in this sample was confirmed using conventional DNA sequencing for Ad5, amplicon sequencing for Ad21, and spotted microarray results (Lin et al., 2004). Yet, the low-level contaminant of Ad7 prototype was still detected and distinguished by high bit scores in a single tile region subsequence. Thus, in this example, an unanticipated mixed adenovirus sample comprised of Ad5 and Ad21, inadvertently contaminated with small amounts of Ad4 and Ad7 prototype (not found in field samples), was completely resolved. Resolution of this fine detail would be impossible using other types of microarrays (i.e. spotted) without anticipation of such types of events and extensive probe design effort.

The resultant hybridization pattern is shown is FIG. 4. Based on the GDAS outputs (using "permissive" settings), REPI identified the following 3 top "hits" for total amplification strategies by multiplex PCR (See Tables 21-24).

TABLE 21

Ad5FIBER: Ad 4-5 Breakthrough Strain

| Accession # | Name | E value: | Bit Score: |
|---|---|---|---|
| lcl\|AY601635 | Human Adenovirus Serotype 5, Field Strain | 5.01036E−76 | 291.899 |
| gi\|33694637\|tpg\|BK000408.1 | TPA: Human adenovirus type 5 | 5.01036E−76 | 291.899 |
| gi\|32127287\|gb\|AY224398.1 | Human adenovirus type 5 strain KNIH 99/5 fiber gene | 5.01036E−76 | 291.899 |

TABLE 22

Ad5HEXON-1: Ad 4-5 Breakthrough Strain

| Accession # | Name | E value: | Bit Score: |
|---|---|---|---|
| lcl\|AY601635 | Human Adenovirus Serotype 5, Field Strain | 0.0 | 644.759 |
| gi\|33694637\|tpg\|BK000408.1 | TPA: Human adenovirus type 5 | 1.81596E−172 | 613.041 |
| gi\|32127287\|gb\|AY224398.1 | Human adenovirus type 5 strain KNIH 99/5 fiber gene | 2.63084E−165 | 589.253 |

TABLE 23

Ad7E1A: Ad 4-5 Breakthrough Strain

| Accession # | Name | E value: | Bit Score: |
|---|---|---|---|
| gi\|4127293\|emb\|AJ005536.1\|ACA005536 | Adenovirus clinical isolate, clone B44 from genomic DNA | 3.18875E−83 | 315.688 |
| lcl\|AY601633 | Human Adenovirus Serotype 21 | 4.97873E−82 | 311.723 |
| gi\|21311720\|gb\|AF492353.1 | Human adenovirus type 21 E1A 13S protein gene | 1.21371E−79 | 303.794 |
| lcl\|AY601634 | Human Adenovirus Serotype 7, US Navy Field Strain | 2.95877E−77 | 295.864 |

TABLE 24

Ad7HEXON-1: Ad 4-5 Breakthrough Strain

| Accession # | Name | E value | Bit Score: |
|---|---|---|---|
| lcl\|AY601633 | Human Adenovirus Serotype 21 | 6.98074E−24 | 117.452 |
| gi\|13919592\|gb\|AY008279.1 | Human adenovirus type 21 hexon protein gene | 6.98074E−24 | 117.452 |
| gi\|21311720\|gb\|AF492353.1 | Human adenovirus type 50 Human Adenovirus Serotype 7 | 6.98074E−24 6.0101E−12 | 117.452 77.8048 |
| lcl\|AY594255 | | | |
| lcl\|AY601634 | Human Adenovirus Serotype 7, US Navy Field Strain | 6.0101E−12 | 77.8048 |

Selected REPI return values for Adenovirus 4,5 Breakthrough Strain on RPMV1. This "strain" was determined by several independent means to be a mixture of adenovirus type 5 and a B subgroup member, most likely being adenovirus type 21. This was borne out in the combined hybridization results and REPI analysis, with adenovirus type 5 being confirmed on all adenovirus 5 tiles, while the B subgroup prototype (adenovirus 7; AY594255) tiles returned the highest bit scores for a adenovirus type 21, a different member of the B subgroup.

Conventional DNA sequencing revealed that the complete adenovirus 5 genome was recovered and that other sequences were present that could not be assembled because an Adenovirus 5 model assumption was required. However, a significant amount of corroborating evidence was amassed to Support the conclusion of an Ad5/Ad 21 co-infection, including similar results obtained in parallel experiments with 70-mer oligonucleotide arrays (Lin et al 2004) showing evidence of an Ad 5/Ad 21 mixture or co-infection, and sequencing of amplicons using conventional approaches that supported the presence of both Ad5 and Ad 21. An extended study conducted subsequently of adenovirus breakthrough strains (in collaboration with NHRC San Diego) showed that a variety of such strains were actually comprised of mixtures of lesser adenoviruses (manuscript in preparation).

There are several significant aspects and advantages implicit in this discovery:

1. demonstration that a prototype region (Ad 7 for B subgroup) could be used to successfully identify a different B subgroup member (Ad 21) without specific a priori design or anticipation of discovering Ad 21 in a sample.
2. demonstration of a microarray to distinguish mixed pathogens due to spatial resolution. This mixture confounded a conventional DNA sequencing approach that relied on assembly of contiguous fragments based on assumption of a single organism.

Example 5

Influenza A Strain Identification Using Prototype Regions

Influenza A positive clinical samples of unknown serotype were collected during the 2002-2003 and 2003-2004 flu seasons and provided to Dr. Zheng Wang as frozen nasal washes by Dr. Elizabeth Walter.

Samples were processed for pathogen chip analysis as follows:

EPICENTRE MasterPure™ DNA Purification Kits (Madison, Wis.) were used to extract total nucleic acids from 50 µl of nasal wash (sample NW20031114-05-02) without RNase treatment. Sample NW20031114-05-02 was collected on Nov. 14, 2003 at Lackland Air Force Base (San Antonio, Tex.). The patient was vaccinated on Nov. 10, 2003. The total nucleic acids were suspended in 20 μl nuclease free H$_2$O. Two-step RT-PCR was employed to amplify each of the viral gene segments.

Briefly, the RNA in 4 μl total nucleic acids was transcribed into cDNA by using SuperScript™ III Reverse Transcriptase (Invitrogen, Carlsbad, Calif.) according to the protocol provided by the manufacturer and 100 pmol Uni3 primer in 20 μl. The RT (reverse transcription) reaction was performed at 42° C. for 1 hr and then was inactivated at 70° C. for 15 min. 2 μl of the RT-reaction was used for cDNA amplification. The cDNA was amplified by using TaqPlus Long System (Stratagene, La Jolla, Calif.) according to protocol provided. Two different PCR conditions were used for amplification. For universal PCR, universal primers uni3 and uni5 were used to amplify all eight segments of hemagglutinin (HA), neuraminidase (NA) and matrix (M) (see Hoffman et al, 2001). For multiplex PCR, segments were amplified by mixing three segment specific primer pairs (Bm-HA-1/Bm-NS-890R, BA-Na-1/Ba-Na-1413R and Bm-M-1/Bm-M-1027R). The final concentration of Mg$^{2+}$-ions was 2 mM and final primer concentration was 1 μM. PCR condition for universal amplification was: 94° C. for 2 min followed by 29 cycles of 94° C. for 1 min, 40° C. for 2 min, 72° C. for 3 min, and final extension at 72° C. for 10 min. The multiplex PCR condition was basically same except that the annealing temperature was raised to 58° C. PCR products were purified by Qiagen PCR Purification kit. 500 ng of universally amplified PCR products and 1000 ng of multiplex PCR products were applied to two V1 Pathogen chips for hybridization according to Affymetrix protocol, respectively.

```
Primer sequences (from Hoffman et al, 2001) -
Uni3:
                              (SEQ ID NO : 431)
AGCAAAAAGCAGG Uni5:
                              (SEQ ID NO : 432)
AGTAGAAACAAG Bm-HA-1:
                              (SEQ ID NO : 433)
TATTCGTCTCAGGGAGCAAAAGCAGGGG Bm-NS-890R:
                              (SEQ ID NO : 434)
ATATCGTCTCGTATTAGTAGAAACAAGGGTGTTTT Ba-Na-1:
                              (SEQ ID NO : 435)
TATTGGTCTCAGGGAGCAAAAGCAGGAGT Ba-Na-1413R:
                              (SEQ ID NO : 436)
ATATGGTCTCGTATTAGTAGAAACAAGGAGTTTTT Bm-M-1:
                              (SEQ ID NO : 437)
TATTCGTCTCAGGGAGCAAAAGCAGGTAG Bm-M-1027R:
                              (SEQ ID NO : 438)
ATATCGTCTCGTATTAGTAGAAACAAGGTAGTTTTT
```

The chip scan results are shown for each of the two amplification protocols: (a) universal primer PCR and (b) multiplex PCR (FIG. 5). Based on the GDAS outputs (using "permissive" settings), REPI identified the following 3 top "hits" for the universal primer (Hoffman et al., 2001) amplification method and total amplification strategies with each of the Ad5 prototype and specific multiplex PCR method (See Table 25).

For this experiment, the present inventors obtained sequence for the HA gene of the Flu strain that evaded the 2003-2004 vaccine and caused widespread illness, namely Fujian/411/2002 (note: only the HA sequence was available for Fujian/411/2002) and incorporated that into the database searched by REPI. Each of the two amplification methods produced effectively the same results, although bit scores varied slightly. Specifically, Fujian 411/2002 returned the highest bit score for FluAHA3 in the REPI output files. Moscow 10/99, the strain used for vaccination in 2003, did not return a REPI output for FluAHA3.

TABLE 25

| FluAHA3: NW20031114-05-02 ACID04-B2 | | | |
|---|---|---|---|
| Accession # | Name | E value: | Bit Score: |
| lcl\|ISDN38157 | InfluenzaA/Fujian/411/2002_Hemagglutinin_104 | 0.0 | 1431.75 |
| gi\|37530025\|gb\|AY389356.1 | Influenza A virus (A/Middleburg/41/03(H3N2)) hemagglutinin (HA) gene | 0.0 | 1431.75 |
| gi\|37530033\|gb\|AY389360.1 | Influenza A virus (A/Pretoria/17/03(H3N2)) hemagglutinin (HA) gene | 0.0 | 1423.83 |
| gi\|37530031\|gb\|AY389359.1 | Influenza A virus (A/Pretoria/16/03(H3N2)) hemagglutinin (HA) gene | 0.0 | 1423.83 |

The highest BLAST bit score for HA3 was achieved for (InfluenzaA/Fujian/411/2002_Hemagglutinin_104), the H3N2 etiologic agent of the 2003-2004 Influenza outbreak in the United States that evaded protection by vaccination. An indistinguishable viral sequence for HA3 also achieved the same bit score. Over 500 GenBank records were returned for HA3, all having expect values of 0.0 and bit scores ranging from those shown above to 995.636. The vaccine strain. (A/Panama/2007/99(H3N2)), was not in the list of returned Influenza A strains in the HA3 region. Note: sequence for InfluenzaA/Fujian/411/2002_Hemagglutinin_104 was only available for HA, so other regions are not compared here.

Although not shown, the present inventors have been able to identify the H1N1 outbreak strain from the 2002-2003 flu season.

Example 6

Reduced Hybridization Times

The Affymetrix CustomSeq protocol specifies that the hybridization step be at least 16 hours to facilitate maximum hybridization. For the intended purpose of a diagnostic capability, this could be prohibitively long. Therefore, the applicability and efficiency of the present methodologies to short hybridization times was assessed, In the present example hybridization and base calling were performed, using samples that were amplified by specific PCR reagents and then hybridized for periods of either 1 hour, 30 minutes, or 15 minutes on the resequencing microarray chip (RPMV1) described above in Preparation Example 1. For this comparative study the Affymetrix CustomSeq protocol was followed with the exception of varying hybridization time. In the example data shown (FIG. 6), a nasal wash that was negative for all targets probed by the microarray except the erythromycin resistance markers SPYERMB, SPYERMTR, and SPYMEFAE was subjected to specific PCR for each of those markers. The amplicons were then hybridized to separate microarrays for either 16 hours or 15 minutes, and then processed otherwise as prescribed by the Affymetrix protocol.

Figure 6B:
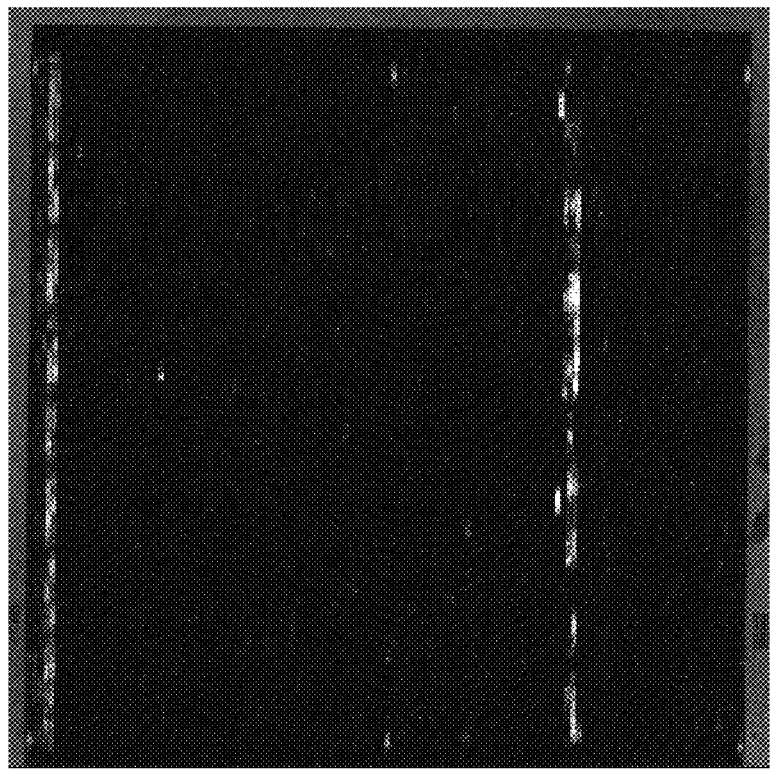
Figure 6A:
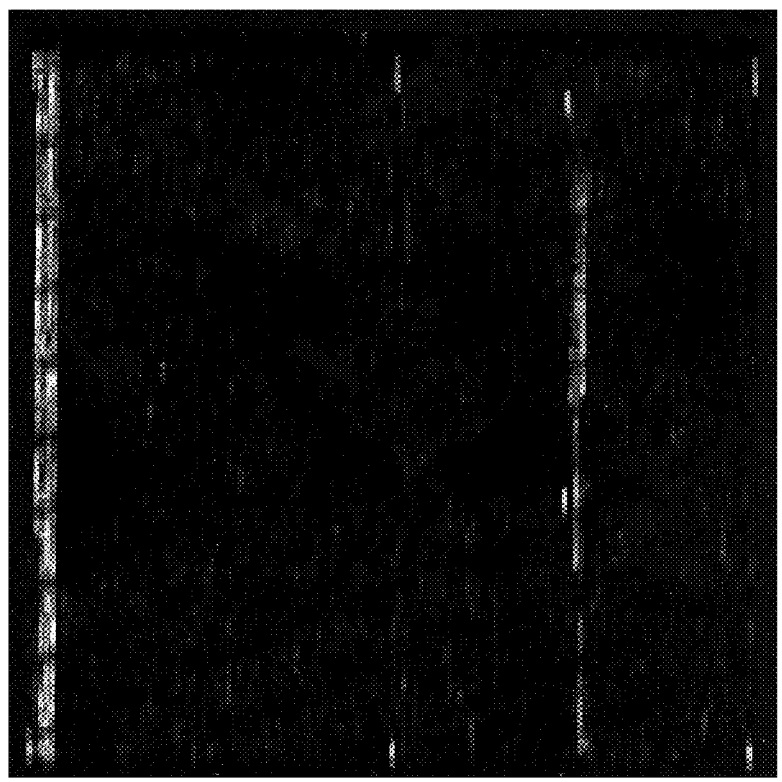

The results appear in FIG. 6A [16 hours; ex-6a]) and FIG. 6B [2 hours; ex-6b]. Based on the GDAS outputs (using "permissive" settings), REPI identified the following 3 top "hits" for the 16 hour hybridization and the 15 minute hybridization, respectively.

The corresponding GDAS and REPI analyses show that the number of base calls resulting is fewer in the case of the 15 minute hybridization compared to that for the 16 hour hybridization (See Tables 26-31). For example, the SPYERMB tile region produced a subsequence length of 219 bp (98% of tile region, 95% base calls made within the subsequence) for a 16 hour hybridization, while discontinuities in the hybridization pattern from a 15 minute hybridization resulted in fragmentation of the tile into two subsequences of lengths 100 bp (45% of tile region, 99% base calls made within subsequence) and 87 bp (39% of tile region, 99% base calls made in subsequence).

TABLE 26

SPYERMB: BL_JMS_020604_TW_3c (16 hour hybridization)

| Accession # | Name | E value: | Bit Score: |
|---|---|---|---|
| gi\|21886737\|gb\|AF516335.1 | Enterococcus faecium plasmid pUW786 multiple antibiotic resistance gene cluster | 1.90377E−98 | 365.247 |

TABLE 27

SPYERMB: BL_JMS_020604_TW_3b (15 minute hybridization)

| Accession # | Name | E value: | Bit Score: |
|---|---|---|---|
| gi\|21886737\|gb\|AF516335.1 | Enterococcus faecium plasmid pUW786 multiple antibiotic resistance gene cluster | 1.6409E−47 | 194.764 |

TABLE 28

SPYERMTR: BL_JMS_020604_TW_3c (16 hour hybridization)

| Accession # | Name | E value: | Bit Score: |
|---|---|---|---|
| gi\|2190969\|gb\|AF002716.1\|AF002716 | Streptococcus pyogenes leader peptides 1 (lpg1) and 2 (lpg2), and erythromycin resistance methylase (ermTR) gene | 3.18989E−13 | 79.787 |

TABLE 29

SPYERMTR: BL_JMS_020604_TW_3b (15 minute hybridization)

| Accession # | Name | E value: | Bit Score: |
|---|---|---|---|
| No calls | N/A | N/A | N/A |

TABLE 30

SPYMEFAE: BL_JMS_020604_TW_3c (16 hour hybridization)

| Accession # | Name | E value: | Bit Score: |
|---|---|---|---|
| gi\|22121182\|gb\|AY071836.1 | Streptococcus sp. 6 macrolide-efflux protein (mefA) gene | 1.01677E−60 | 240.358 |

TABLE 31

SPYMEFAE: BL_JMS_020604_TW_3b (15 minute hybridization)

| Accession # | Name | E value: | Bit Score: |
|---|---|---|---|
| gi\|22121182\|gb\|AY071836.1 | Streptococcus sp. 6 macrolide-efflux protein (mefA) gene | 3.331E−36 | 159.081 |

The tables above show the comparative top rankings for the three different antibiotic resistance markers described in Example 6 for 16 hour versus 15 minute hybridization times. Although the SPYERMTR tile region did not produce a sufficient number of base calls to allow identification following a 15-minute hybridization, both the SPYERMB and SPYMEFAE returned high bit scores for the same variants of the antibiotic resistance markers comprising the tile regions (identified in Table 9).

However, the REPI output for each of the three tile regions showed that the highest bit scores in each region were the same (except for SPYERMTR which lacked sufficient base calls for the 15 minute hybridization), although both the bit scores and expect values were different in each case. Similar results were obtained for 30 minute and 1 hour hybridizations, with an increase in the number of base calls made with increasing hybridization times. Further, this example clearly illustrates the robustness of the method to make fine scale discrimination between targets with a range of different hybridization patterns.

Example 7

Subtractive Hybridization

A variety of methods might be employed to reduce the amount of background human DNA in clinical samples when using total amplification. One method is direct subtraction of the background genomic DNA from amplified products in hybridization solution with COT-1 fraction human genomic DNA that consists largely of rapidly annealing repetitive elements. Another method is bead-based subtraction of background genomic DNA from clinical sample prior to total amplification. A third method is the combination of the above methods, the genomic background DNA from clinical sample were subtracted using bead-based subtraction prior to total amplification, subsequently, the background DNA might be further subtracted from the clinical sample in hybridization solution with COT-1 human DNA.

Figure 7A:
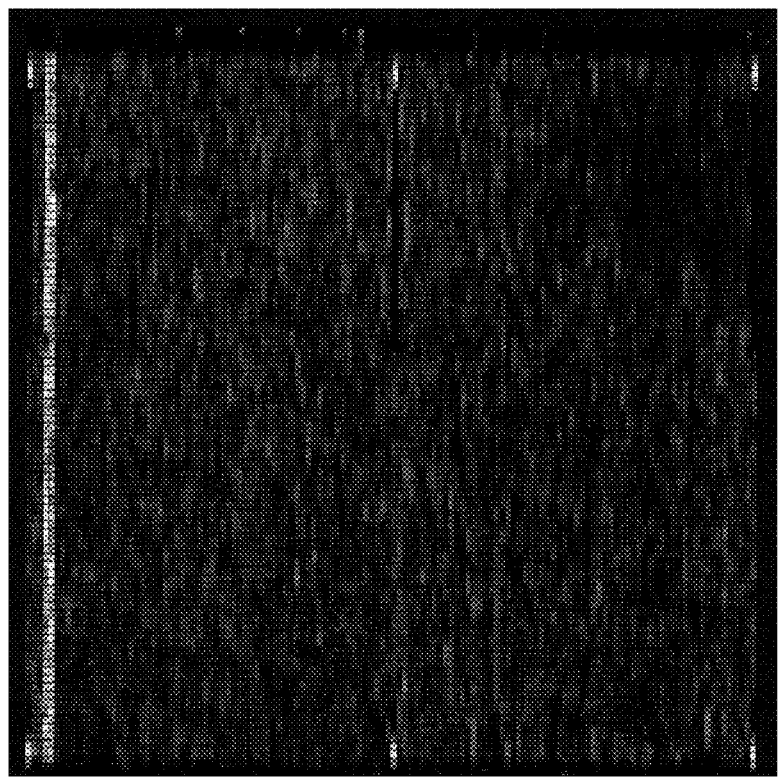
Figure 7B:
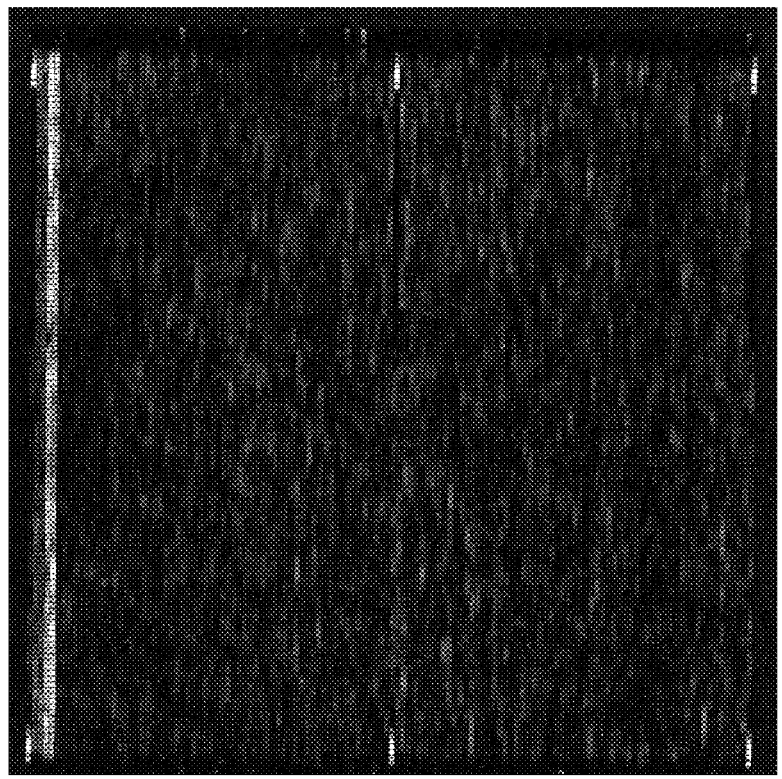

Methods for FIGS. 7A and 7B

A nasal wash was collected from one clinical sample and the total nucleic acid was isolated using MasterPure™ DNA purification kit (Epicentre). The nucleic acid was predigested with McrBc (an endonuclease that cleaves DNA containing methylcytosine on one or both strands) at 37° C. for one hour, and then heated to 65° C. to denature the enzyme. Subsequently, the sample was split to two aliquots and amplified with GenomiPhi DNA amplification kit (Amersham Biosciences). The amplified products were fragmented and labeled according to Affymetrix CustomSeq protocol.

For this comparative study the Affymetrix CustomSeq protocol was followed except for the following changes. The clinical sample was hybridized to the resequencing microarray chips (RPMV1) either with standard hybridization solution according to Affymetrix CustomSeq protocol (FIG. 7A) or with hybridization mixture containing 12 μg Herring Sperm DNA and 10 μg COT-1 human DNA (Roche, Indianapolis, Ind.) instead of 22 μg Herring sperm DNA as Affymetrix recommended (FIG. 7B).

Methods for FIGS. 7C and 7D

The present example describes bead-base subtraction and the combination of bead-base subtraction with subtractive hybridization methods for increasing the pathogen specific signal-to-noise ratio when using total amplification.

COT-1 human DNA, consisting largely of rapidly annealing repetitive elements, was biotinylated at 3'-end using terminal transferase (Tdt) (NEB) to generate Biotinylated Subtraction Probes (BSPs). An aliquot of ~400 ng of BSPs was incubated at 95° C. for 10 minutes in 4×SSC and 0.2% SDS with nucleic acid extract of clinical nasal wash (diagnosed as Ad4 positive clinical sample) predigested with McrBC at 37° C. for one hour, then slowly cooled to 65° C. to allow co-hybridization with the HMB for one hour. After hybridization, the BSP-HMB complexes were incubated at room temperature for 30 minutes at 1×PBS, 0.1% BSA with BcMag.Streptavidin Magnetic Beads (SMBs, Bioclone). The beads were separated from supernatant using a magnetic separator. The supernatant was then transferred to a new tube and the magnetic beads were washed once with 1×PBS, 0.1% BSA. The supernatants were combined and precipitated with ethanol. The DNA pellet was resuspended with nuclease free water (Ambion) then split to two aliquots and amplified with GenomiPhi DNA amplification kit (Amersham Biosciences) according to the manufacture recommended protocol. Briefly, 1 ml DNA template was denatured with 9 μl of sample buffer at 95° C. for 3 minutes, the cooled down to 4° C. In a separate tube, 1 μl of enzyme was mixed with 9 μl of reaction buffer, and then the mixture was added to the denatured DNA template. The reaction was then performed at 30° C. for 18 hours at Thermal Cycler-PTC225 (MJ Research Inc., Reno, Nev.).

For this comparative study, the amplified products were hybridized to the resequencing microarray chips (RPMV1) either with standard hybridization solution according to Affymetrix CustomSeq protocol (FIG. 7C) or with hybridization mixture containing 12 μg Herring Sperm DNA and 10 μg COT-1 human DNA instead of 22 μg Herring sperm DNA as Affymetrix recommended (FIG. 7D).

Methods for FIG. 7E

The combination of bead-base subtraction and subtractive hybridization procedure was repeated with double amount of initial material and the result appearing in FIG. 7E evidenced that the present inventors were able to subtract human background from clinical sample for the resequencing microarray chip (RPM Version 1 chip) described above in Preparation Example 1 to resolve the presence and identification of Ad4 hexon and fiber genes in the clinical sample.

Subtractive Hybridization Results

The results of the subtractive hybridization approaches are shown in FIG. 7. As shown in FIG. 7A, total amplification of the isolated nucleic acids resulted in significant background hybridization to the RPMV1 microarray. Although the adenovirus type 4 region showed a discernibly higher signal than that of the overall background, GDAS was unable to make enough base calls to satisfy the sliding window condition in REPI, so no attempts to BLAST the data were made. Co-hybridizing the same set of total amplicons with COT-1 human genomic DNA did little to improve this (FIG. 7B) and no base calls were made. FIG. 7C shows that the use of a magnetic bead-based subtraction alone, prior to total amplification, again did not result in a sufficient number of base calls to allow similarity searching.

However, through the combined use of a bead-based subtraction prior to amplification and co-hybridization with COT-1 human DNA, enough base calls could be made to identify and rank the adenovirus 4 field strains (Navy and Air Force without discrimination) higher than those of the vaccine and prototype adenovirus 4 strains in each of three subsequences identified in the Ad4HEXON-1 tile region (FIG. 7D and Table 32).

TABLE 32

Ad4HEXON-1: BL__818141__030503__NW__4

| Accession # | Name | E value: | Bit Score: |
|---|---|---|---|
| lcl\|AY599837 | Human Adenovirus serotype 4, USAF Field Strain | 6.14232E−37 | 161.064 |
| lcl\|AY599835 | Human Adenovirus serotype 4, US Navy Field Strain | 6.14232E−37 | 161.064 |
| lcl\|AY594254 | Human Adenovirus serotype 4, vaccine strain | 1.49737E−34 | 153.134 |
| lcl\|AY594253 | Human Adenovirus Serotype 4 | 1.49737E−34 | 153.134 |

Moreover, by performing the same set of combined steps using 2 microliters of starting sample material instead of 1 microliter (FIG. 7E), base calling was extended into the Ad4FIBER tile region (see Table 33) in addition to Ad4HEXON-1 (see Table 34), allowing unambiguous high bit-score ranking for Ad4 Field Strain (though not distinguishing between Air Force and Navy field strains) versus prototype (AY594253) or vaccine strain (AY594254) in several Ad4FIBER subsequences. However, the Ad4 Air Force Field Strain (Accession No. AY599837) was distinguishable from the Navy field strain (AY599835) in the Ad4HEXON-1 tile because an increased number of base calls allowed for a more complete sequence comparison and increased bit score resolution.

TABLE 33

Ad4FIBER: BL__818141__030503__NW__9b

| Accession # | Name | E value: | Bit Score: |
|---|---|---|---|
| lcl\|AY599837 | Human Adenovirus serotype 4, USAF Field Strain | 3.51948E−22 | 111.505 |
| lcl\|AY599835 | Human Adenovirus serotype 4, US Navy Field Strain | 3.51948E−22 | 111.505 |
| lcl\|AY594254 | Human Adenovirus serotype 4, vaccine strain | 8.57976E−20 | 103.575 |
| lcl\|AY594253 | Human Adenovirus Serotype 4 | 8.57976E−20 | 103.575 |

TABLE 34

Ad4HEXON-1: BL__818141__030503__NW__9b

| Accession # | Name | E value: | Bit Score: |
|---|---|---|---|
| lcl\|AY599837 | Human Adenovirus serotype 4, USAF Field Strain | 1.59752E−70 | 274.058 |
| lcl\|AY599835 | Human Adenovirus serotype 4, US Navy Field Strain | 9.49375E−66 | 258.199 |
| lcl\|AY594254 | Human Adenovirus serotype 4, vaccine strain | 5.64196E−61 | 242.34 |
| lcl\|AY594253 | Human Adenovirus Serotype 4 | 5.64196E−61 | 242.34 |

Example 8

RPMV2 Chip and Design Thereof

A listing of the sequence tiles for the RPM V2 chip is listed below in (Table 35). This represented an approximate 10-fold increase in the content of the RPM V1 chip.

TABLE 35

RPMV2 Chip Table

| Alias | Organism | Gene Name | Accession Number: Seq Num | Length | SEQ ID NO: |
|---|---|---|---|---|---|
| ATTIM1 | Arabidopsis thaliana(1) | triosephosphate isomerase (TIM) | | 523 | 59 |
| Ad3E1A | Adenovirus 3 | E1A | AY599834: 576-1455 | 879 | 60 |
| Ad3HEXON | Adenovirus 3 | Hexon | AY599834: 18420-21254 | 595 | 61 |
| Ad3FIBER | Adenovirus 3 | Fiber | AY599834: 31370-32329 | 746 | 62 |
| Ad7E1A | Adenovirus 7 | E1A | AY594255: 577-1445 | 868 | 63 |
| Ad7HEXON | Adenovirus 7 | Hexon | AY594255: 18419-21232 | 513 | 64 |
| Ad7FIBER | Adenovirus 7 | Fiber | AY594255: 31320-32297 | 977 | 65 |
| Ad7NAVYE1A | Adenovirus 7 FS Navy | E1A | AY601634: 575-1454 | 879 | 66 |
| Ad7NAVYHEXON | Adenovirus 7 FS Navy | Hexon | AY601634: 18408-21210 | 504 | 67 |
| Ad7NAVYFIBER | Adenovirus 7 FS Navy | Fiber | AY601634: 31320-32295 | 975 | 68 |
| Ad16E1A | Adenovirus 16 | E1A | AY601636: 574-1452 | 878 | 69 |
| Ad16HEXON | Adenovirus 16 | Hexon | AY601636: 18450-21272 | 667 | 70 |
| Ad16FIBER | Adenovirus 16 | Fiber | AY601636: 31448-32509 | 652 | 71 |
| Ad21E1A | Adenovirus 21 | E1A | AY601633: 574-1452 | 878 | 72 |
| Ad21HEXON | Adenovirus 21 | Hexon | AY601633: 18454-21303 | 807 | 73 |
| Ad21FIBER | Adenovirus 21 | Fiber | AY601633: 31406-32377 | 685 | 74 |
| Ad11E1A | Adenovirus 11 | E1A | AY163756: 568-1440 | 872 | 75 |
| Ad11EXON | Adenovirus 11 | Hexon | AY163756: 18254-21100 | 677 | 76 |
| Ad11FIBER | Adenovirus 11 | Fiber | AY163756: 30811-31788 | 977 | 77 |
| Ad35E1A | Adenovirus 35 | E1A | AY271307: 569-1441 | 872 | 78 |
| Ad35HEXON | Adenovirus 35 | Hexon | AY271307: 18257-21115 | 689 | 79 |
| Ad35FIBER | Adenovirus 35 | Fiber | AY271307: 30827-31798 | 971 | 80 |
| Ad1E1A | Adenovirus 1 | E1A | 33330439: 560-1546 | 986 | 81 |
| Ad1HEXON | Adenovirus 1 | Hexon | 33330439: 18861-21755 | 715 | 82 |
| Ad1FIBER | Adenovirus 1 | Fiber | 33330439: 31101-32849 | 750 | 83 |
| Ad2E1A | Adenovirus 2 | E1A | 33694600: 559-1542 | 983 | 84 |
| Ad2HEXON | Adenovirus 2 | Hexon | 33694600: 18838-21744 | 837 | 85 |
| Ad2FIBER | Adenovirus 2 | Fiber | 33694600: 31030-32778 | 750 | 86 |
| Ad5E1A | Adenovirus 5 | E1A | 33465830: 560-1545 | 985 | 87 |
| Ad5HEXON | Adenovirus 5 | Hexon | 33465830: 18842-21700 | 732 | 88 |
| Ad5FIBER | Adenovirus 5 | Fiber | 33465830: 31037-32782 | 747 | 89 |
| Ad6E1A | Adenovirus 6 | E1A | CBI | 985 | 90 |
| Ad6HEXON | Adenovirus 6 | Hexon | X67710 | 833 | 91 |
| Ad6FIBER | Adenovirus 6 | Fiber | AB108424 | 750 | 92 |
| Ad4E1A | Adenovirus 4 | E1A | AY594253: 576-1441 | 865 | 93 |
| Ad4HEXON | Adenovirus 4 | Hexon | AY594253: 18248-21058 | 2810 | 94 |
| Ad4FIBER | Adenovirus 4 | Fiber | AY594253: 31645-32922 | 1277 | 95 |
| Ad4AFE1A | Adenovirus 4 FS AF | E1A | AY599837: 575-1407 | 832 | 96 |
| Ad4AFHEXON | Adenovirus 4 FS AF | Hexon | AY599837: 18179-20989 | 2810 | 97 |
| Ad4AFFIBER | Adenovirus 4 FS AF | Fiber | AY599837: 31463-32740 | 1277 | 98 |
| Ad12E1A | Adenovirus 12 | E1A | 9626621: 503-1099 | 597 | 99 |
| Ad12HEXON | Adenovirus 12 | Hexon | 9626621: 17740-20499 | 884 | 100 |
| Ad12FIBER | Adenovirus 12 | Fiber | 9626621: 29368-31131 | 908 | 101 |
| Ad17E1A | Adenovirus 17 | E1A | 9632407: 560-1138 | 579 | 102 |

TABLE 35-continued

RPMV2 Chip Table

| Alias | Organism | Gene Name | Accession Number: Seq Num | Length | SEQ ID NO: |
|---|---|---|---|---|---|
| Ad17HEXON | Adenovirus 17 | Hexon | 9632407: 17754-20617 | 692 | 103 |
| Ad17FIBER | Adenovirus 17 | Fiber | 9632407: 30935-32035 | 829 | 104 |
| Ad40E1A | Adenovirus 40 | E1A | 9626553: 418-1326 | 824 | 105 |
| Ad40HEXON | Adenovirus 40 | Hexon | 9626553: 17643-20414 | 876 | 106 |
| Ad40FIBER | Adenovirus 40 | Fiber | 9626553: 28751-29914 | 707 | 107 |
| FluAHA1 | Influenza A H1N1 (New Caledonia Like) | Hemagglutinin 1 | AJ344014 | 1692 | 108 |
| FluAHA2 | Influenza A H2N2 (berkley) | Hemagglutinin 2 | L11125 | 805 | 109 |
| FluAHA3 | Influenza A H3N2 (Fujian) | Hemagglutinin 3 | ISDN38157 | 1042 | 110 |
| FluAHA4 | Influenza A H4N6 (Swine: Ontario) | Hemagglutinin 4 | AF285885 | 1371 | 111 |
| FluAHA5 | Influenza A H5N1 (Vietnam) | Hemagglutinin 5 | AY526745 | 303 | 112 |
| FluAHA6 | Influenza A H6N2 (Turkey; Germany) | Hemagglutinin 6 | AJ507203 | 887 | 113 |
| FluAHA7 | Influenza A H7N7 (Netherlands) | Hemagglutinin 7 | AY338459 | 818 | 114 |
| FluAHA8 | Influenza A H8N4 (Duck; Alberta) | Hemagglutinin 8 | AF310988 | 897 | 115 |
| FluAHA9 | Influenza A H9N2 (Swine: China) | Hemagglutinin 9 | AY294658 | 601 | 116 |
| FluAHA10 | Influenza A H10 (Shorebird) | Hemagglutinin 10 | AF311750 | 775 | 117 |
| FluAHA11 | Influenza A H11 (Duck; Taiwan) | Hemagglutinin 11 | AF310986 | 728 | 118 |
| FluAHA12 | Influenza A H12N4 (Ruddy Turnstone; Delaware) | Hemagglutinin 12 | AF310990 | 738 | 119 |
| FluAHA13 | Influenza A H13N6 (Gull; Astrakan) | Hemagglutinin 13 | M26089 | 1765 | 120 |
| FluAHA14 | Influenza A H14 (mallard; Gurjev) | Hemagglutinin 14 | M35997 | 763 | 121 |
| FluAHA15 | Influenza A H15N8 (Duck; Australia) | Hemagglutinin 15 | L43916 | 793 | 122 |
| FluANA1-1 | Influenza A H1N1 (New Caledonia Like) | Neuraminidase 1 | AJ518092 | 1459 | 123 |
| FluANA1-2 | Influenza A H5N1 (Vietnam) | Neuraminidase 1 | AY526746 | 575 | 124 |
| FluANA2 | Influenza A H3N2 (Ireland) | Neuraminidase 2 | AJ457947 | 1062 | 125 |
| FluANA3 | Influenza A H5N3 (chicken: TX) | Neuraminidase 3 | AY300947 | 852 | 126 |
| FluANA4 | Influenza A H8N4 (Duck; Alberta) | Neuraminidase 4 | K01030 | 257 | 127 |
| FluANA5 | Influenza A H6N5 (Shearwater) | Neuraminidase 5 | M24740 | 913 | 128 |
| FluANA6 | Influenza A H4N6 (Swine: Ontario) | Neuraminidase 6 | AF285887 | 739 | 129 |
| FluANA7 | Influenza A H7N7 (Netherlands) | Neuraminidase 7 | AY340079 | 994 | 130 |
| FluANA8 | Influenza A H5N8 (Duck: NY) | Neuraminidase 8 | AY300948 | 843 | 131 |
| FluANA9 | Influenza A H2N9 (Duck: Nanchang) | Neuraminidase 9 | AY180830 | 444 | 132 |
| FluAH1N1MATRIX | Influenza A H1N1 (New Caledonia Like) | Matrix | AJ458301 | 734 | 133 |
| FluAH5N1MATRIX | Influenza A H5N1 (Vietnam) | Matrix | AY526748 | 657 | 134 |
| FluBHA | Influenza B | Hemagglutinin B | AB126838 | 785 | 135 |
| FluBNA | Influenza B | Neuraminidase B | AY139074 | 809 | 136 |
| FluBMATRIX | Influenza B | Matrix | AB036877 | 763 | 137 |
| FluCHA | Influenza C | Hemagglutinin-esterase | AB093473 | 401 | 138 |
| FluCMATRIX | Influenza C | Matrix | AB086809 | 862 | 139 |
| PIV1HN | Parainfluenza 1 | Hemagglutinin-neuraminidase | 19718363: 6903-8630 | 1728 | 140 |
| PIV1MATRIX | Parainfluenza 1 | Matrix | 19718363: 3637-4809 | 958 | 141 |
| PIV1NC | Parainfluenza 1 | Nucleocapsid | 19718363: 56-1737 | 1682 | 142 |
| PIV2HN | Parainfluenza 2 | Hemagglutinin-neuraminidasegi | 19525721: 6817-8532 | 1716 | 143 |
| PIV2MATRIX | Parainfluenza 2 | Matrix | 19525721: 3411-4742 | 741 | 144 |
| PIV2NC | Parainfluenza 2 | Nucleocapsid | 19525721: 71-1919 | 1849 | 145 |
| PIV3HN | Parainfluenza 3 | Hemagglutinin-neuraminidase | 10937870: 6806-8530 | 1725 | 146 |
| PIV3MATRIX | Parainfluenza 3 | Matrix | 10937870: 3753-4814 | 544 | 147 |
| PIV3NC | Parainfluenza 3 | Nucleocapsid | 10937870: 111-1658 | 1548 | 148 |
| PIV4HN | Parainfluenza 4 | Hemagglutinin-neuraminidase | E02727 | 686 | 149 |
| PIV4MATRIX | Parainfluenza 4 | Matrix | E03809 | 855 | 150 |
| HRV14NCR | Rhinovirus 14 | 5' NCR | AF108186 | 520 | 151 |
| HRV1ANCR | Rhinovirus 1A | 5' NCR | AF108179 | 511 | 152 |
| HRV21NCR | Rhinovirus 21 | 5' NCR | AF108180 | 499 | 153 |

TABLE 35-continued

RPMV2 Chip Table

| Alias | Organism | Gene Name | Accession Number: Seq Num | Length | SEQ ID NO: |
|---|---|---|---|---|---|
| HRV29NCR | Rhinovirus 29 | 5' NCR | AF542420 | 676 | 154 |
| HRV58NCR | Rhinovirus 58 | 5' NCR | AF108183 | 504 | 155 |
| HRV62NCR | Rhinovirus 62 | 5' NCR | AF108184 | 501 | 156 |
| HRV87NCR | Rhinovirus 87 | 5' NCR | AF108187 | 506 | 157 |
| HRV95NCR | Rhinovirus 95-01468 | 5' NCR | AF108164 | 508 | 158 |
| RSVABL | RSV A&B | polymerase L | AF254574 | 379 | 159 |
| RSVAMATRIX | RSV A | Matrix | 3089371: 3253-4210 | 958 | 160 |
| RSVANC | RSV A | Nucleocapsid | 3089371: 1126-2398 | 955 | 161 |
| RSVBMATRIX | RSV B | Matrix | 2582022: 3263-4033 | 770 | 162 |
| RSVBNC | RSV B | Nucleocapsid | 2582022: 1140-2315 | 602 | 163 |
| HCV229ESPIKE | Coronavirus 229E | Spike | 12175745: 20570-24091 | 1534 | 164 |
| HCV229EMEM | Coronavirus 229E | Membrane protein | 12175745: 24995-25672 | 678 | 165 |
| HCV229ENC | Coronavirus 229E | Nucleocapsid | 12175745: 25686-26855 | 924 | 166 |
| HCVOC43SPIKE | Coronavirus OC43 | Spike | 38018022: 23644-27729 | 1456 | 167 |
| HCVOC43MEM | Coronavirus OC43 | Membrane protein | 38018022: 28402-29094 | 693 | 168 |
| HCVOC43NC | Coronavirus OC43 | Nucleocapsid | 38018022: 29104-30450 | 966 | 169 |
| SARSSPIKE | Coronavirus SARS (Urbani) | Spike | 30027617: 21492-25259 | 1438 | 170 |
| SARSMEM | Coronavirus SARS (Urbani) | Membrane Glycoprotein | 30027617: 26398-27063 | 666 | 171 |
| SARSNC | Coronavirus SARS (Urbani) | Nucleocapsid | 30027617: 28120-29388 | 932 | 172 |
| HCVNL63SPIKE | Coronavirus NL63 | Spike | AY567487: 20472-24542 | 1534 | 173 |
| HCVNL63ORF3 | Coronavirus NL63 | ORF3 | AY567487: 24542-25219 | 678 | 174 |
| HCVNL63MEM | Coronavirus NL63 | Membrane protein | AY567487: 25442-26122 | 681 | 175 |
| HCVNL63NC | Coronavirus NL63 | Nucleocapsid | AY567487: 26133-27266 | 879 | 176 |
| MPVMATRIX | Metapneumovirus | Matrix | AY145271 | 765 | 177 |
| MPVNC | Metapneumovirus | Nucleocapsid | AY145272 | 1185 | 178 |
| HHV1L | Human herpesvirus 1 (Simplex) | DNA polymerase | 9629378: 62807-66514 | 1061 | 179 |
| HHV1CAPSID | Human herpesvirus 1 (Simplex) | major capsid protein | 9629378: c40528-36404 | 993 | 180 |
| HHV3L | Human herpesvirus 3 (VZV) | DNA polymerase | 9625875: c50636-47052 | 1061 | 181 |
| HHV3CAPSID | Human herpesvirus 3 (VZV) | major capsid protein | 9625578: 71540-75730 | 993 | 182 |
| HHV4L | Human herpesvirus 4 (EBV) | DNA polymerase | 9625578: c156746-153699 | 1067 | 183 |
| HHV4CAPSID | Human herpesvirus 4 (EBV) | major capsid protein | 9625578: c137466-133321 | 992 | 184 |
| HHV5L | Human herpesvirus 5 (CMV) | DNA polymerase | 9628290: c59588-56550 | 1136 | 185 |
| HHV5CAPSID | Human herpesvirus 5 (CMV) | major capsid protein | 9628290: c129226-125114 | 998 | 186 |
| HHV6L | Human herpesvirus 6 (Roleola) | DNA polymerase | 9628290: c59588-56550 | 1058 | 187 |
| HHV6CAPSID | Human herpesvirus 6 (Roleola) | major capsid protein | 9628290: c93912-89875 | 1001 | 188 |
| ENTEROVIRUS | Enterovirus (genus) | Enterovirus | NC_001612 | 1758 | 189 |
| COXSACKIEVIRUS | Human coxsackievirus | unknown | AF499635 | 920 | 190 |
| ECHO | Echo (subgroup) | Echovirus | NC_003986 | 1277 | 191 |
| POLIO | Polio (subgroup) | Poliovirus | NC_002058 | 1226 | 192 |
| POLIO1NCR | Polio type 1 Sabin | 5'NCR | AY184219: 162-597 | 436 | 193 |
| POLIO2NCR | Polio type 2 Sabin | 5'NCR | AY184220: 162-598 | 437 | 194 |
| POLIO3NCR | Polio type 3 Sabin | 5'NCR | AY184221: 164-600 | 437 | 195 |
| MEASLESHA | Paramyxoviridae morbillivirus (Rubeola) | Hemagglutinin | AY523581 | 1854 | 196 |
| MEASLESMATRIX | Paramyxoviridae morbillivirus (Rubeola) | Matrix | 9626945: 3438-4445 | 1008 | 197 |
| NEWCASTLEHN | Newcastle | Hemagglutinin-Neuraminidase | AY510092 | 1734 | 198 |
| NEWCASTLEMATRIX | Newcastle disease | Matrix | 11545722: 3256-4487 | 1232 | 199 |
| WNE | West Nile Virus | Envelope | AF346319 | 1504 | 200 |
| WNNS | West Nile Virus | Nonstructural protein 5 | AF208017 | 917 | 201 |
| WNCM | West Nile virus | C and prM | | 432 | 202 |
| YFE | Yellow Fever | Envelope | AY359908 | 1547 | 203 |
| YFNS | Yellow Fever | Nonstructural protein 5 | AF013417 | 1035 | 204 |
| VMVG3R | Variola major virus | G3R | 623595: 183809-184570 | 762 | 205 |
| VMVHA | Variola major virus | hemagglutinin | 623595: 151032-151973 | 942 | 206 |
| VMVSOD | Variola major virus | SOD | 623595: 144137-144514 | 378 | 207 |
| VMVCRMB | Variola major virus | CrmB | | 291 | 208 |
| MONKEYPOX | Monkeypox virus | inclusion body protein | U84503 | 812 | 209 |
| EBOLAL | Reston Ebola | L | 22789222: 11464-18866 | 800 | 210 |
| EBOLANP | Reston Ebola | NP | 22789222: 56-3013 | 806 | 211 |
| EBOLAMATRIX | Reston Ebola | Matrix | 22789222: 4396-5893 | 1498 | 212 |
| MARBURGL | Marburg virus | L protein | 13489275: 11479-18474 | 1218 | 213 |
| MARBURGNP | Marburg virus | NP | 13489275: 103-2190 | 847 | 214 |
| LASSAL | Lassa virus | L | 23343512: c7122-466 | 1021 | 215 |
| LASSANP | Lassa virus | Nucleoprotein | 23343509: 101-1810 | 751 | 216 |
| LASSAGP | Lassa virus | Glycoprotein | 23343509: c3347-1872 | 1476 | 217 |
| MACHUPOL | Machupo virus | L polymerase | 34365535: c7094-465 | 1588 | 218 |
| MACHUPONP | Machupo virus | Nucleoprotein | 34365532: c3364-1670 | 763 | 219 |
| MACHUPOG | Machupo virus | Glycoprotein | 34365532: 89-1579 | 1491 | 220 |

TABLE 35-continued

RPMV2 Chip Table

| Alias | Organism | Gene Name | Accession Number: Seq Num | Length | SEQ ID NO: |
|---|---|---|---|---|---|
| VEEVNS | Venezuelan equine encephalitis virus | NS | 9626526: 1-7526 | 923 | 221 |
| VEEVNC | Venezuelan equine encephalitis virus | Structrual protein | 9626526: 7532-11444 | 1512 | 222 |
| EEEVNS | Eastern equine encephalitis virus | NS | 21218484: 47-5683 | 1312 | 223 |
| EEEVNC | Eastern equine encephalitis virus | Nucleocapsid | 21218484: 7592-11317 | 975 | 224 |
| WEEVNS | Western equine encephalitis virus | NS | 21238454: 25-7428 | 878 | 225 |
| WEEVNC | Western equine encephalitis virus | Structrual protein | 21238454: 7473-11183 | 902 | 226 |
| NIPAHMATRIX | Nipah virus | Matrix | 13559808: 5008-6366 | 1359 | 227 |
| NIPAHN | Nipah virus | N | 13559808: 56-2297 | 858 | 228 |
| SINNOMBREGP | Sin Nombre | Glycoprotein | 558060: 52-3474 | 1293 | 229 |
| SINNOMBRENC | Sin Nombre | Nucleocapsid | 38371725: 43-1329 | 639 | 230 |
| NORWALKL | Norwalk virus | RNA-dependent RNA polymerase | 9630803: 3848-5371 | 739 | 231 |
| NORWALKCAPSID | Norwalk virus | capsid protein | 9630803: 5358-6950 | 760 | 232 |
| DENGUECAPSID | Dengue virus | capsid protein | 9626681: 97-396 | 300 | 233 |
| DENGUEM | Dengue virus | pre-M protein | 9626681: 439-936 | 498 | 234 |
| DENGUE1NCR | Dengue type 1 | 3'NCR | AF309641: 10501-10657 | 157 | 235 |
| DENGUE2NCR | Dengue type 2 | 3'NCR | AF359579: 10501-10659 | 159 | 236 |
| DENGUE3NCR | Dengue type 3 | 3'NCR | AF317645: 10477-10632 | 156 | 237 |
| DENGUE5NCR | Dengue type 4 | 3'NCR | AF326573: 10424-10585 | 162 | 238 |
| FMDVVP1 | Foot and mouth disease virus | VP1 | 21426907: 3231-3863 | 633 | 239 |
| FMDV3D | Foot and mouth disease virus | 3D | 21426907: 6615-8024 | 846 | 240 |
| SLEVNS5 | Saint Louis encephalitis virus | NS5 | AF013416 | 1035 | 241 |
| SLEVPP | Saint Louis encephalitis virus | polyprotein precursor | AY289618 | 727 | 242 |
| RVFVN | Rift Valley fever virus | N | 61928: c1652-915 | 738 | 243 |
| RVFVNS | Rift Valley fever virus | NS | 61928: 35-832 | 798 | 244 |
| USUTUPP | Usutu virus | polyprotein | AF452643 | 1035 | 245 |
| JEVPP | Japanese encephalitis virus | polyprotein | M18370: 9062-10097 | 1035 | 246 |
| CHANDIPURAMATRIX | Chandipura virus | Matrix | 4583436: 97-851 | 755 | 247 |
| CHANDIPURAGP | Chandipura virus | glycoprotein | J04350 | 752 | 248 |
| ATTIM2 | *Arabidopsis thaliana*(2) | triosephosphate isomerase (TIM) | | 523 | 249 |
| ATTIM3 | *Arabidopsis thaliana*(3) | triosephosphate isomerase (TIM) | | 523 | 250 |
| SPYEMM1 | *Streptococcus pyogenes* | emm1 | CDC | 398 | 251 |
| SPYEMM2 | *Streptococcus pyogenes* | emm2 | CDC | 360 | 252 |
| SPYEMM3 | *Streptococcus pyogenes* | emm3 | CDC | 391 | 253 |
| SPYEMM4 | *Streptococcus pyogenes* | emm4 | CDC | 337 | 254 |
| SPYEMM5 | *Streptococcus pyogenes* | emm5 | CDC | 490 | 255 |
| SPYEMM6 | *Streptococcus pyogenes* | emm6 | CDC | 437 | 256 |
| SPYEMM9 | *Streptococcus pyogenes* | emm9 | CDC | 509 | 257 |
| SPYEMM11 | *Streptococcus pyogenes* | emm11 | CDC | 500 | 258 |
| SPYEMM12 | *Streptococcus pyogenes* | emm12 | CDC | 364 | 259 |
| SPYEMM13L | *Streptococcus pyogenes* | emm13L | CDC | 325 | 260 |
| SPYEMM18 | *Streptococcus pyogenes* | emm18 | CDC | 524 | 261 |
| SPYEMM22 | *Streptococcus pyogenes* | emm22 | CDC | 620 | 262 |
| SPYEMM28 | *Streptococcus pyogenes* | emm28 | CDC | 333 | 263 |
| SPYEMM29 | *Streptococcus pyogenes* | emm29 | CDC | 328 | 264 |
| SPYEMM44 | *Streptococcus pyogenes* | emm44 | CDC | 391 | 265 |
| SPYEMM61 | *Streptococcus pyogenes* | emm61 | CDC | 325 | 266 |
| SPYEMM75 | *Streptococcus pyogenes* | emm75 | CDC | 451 | 267 |
| SPYEMM77 | *Streptococcus pyogenes* | emm77 | CDC | 450 | 268 |
| SPYEMM89 | *Streptococcus pyogenes* | emm89 | CDC | 378 | 269 |
| SPYEMM94 | *Streptococcus pyogenes* | emm94 | CDC | 516 | 270 |
| SPYCSR | *Streptococcus pyogenes* | Csr R & Csr S | AF095713 | 952 | 271 |
| SPYSFB1 | *Streptococcus pyogenes* | sfb1 | AJ347842 | 615 | 272 |
| SPYSPEB | *Streptococcus pyogenes* | SpeB | AB051298 | 729 | 273 |
| SPNGYRA | *Streptococcus pneumoniae* | GyrA | AY157689 | 815 | 274 |
| SPNLYTA | *Streptococcus pneumoniae* | Autolysin lytA | | 125 | 275 |
| SPNPLY | *Streptococcus pneumoniae* | pneumolysin ply | | 99 | 276 |
| SAUGYRA | *Staphylococcus aureus* | GyrA | D10489 | 821 | 277 |
| SAUTST | *Staphylococcus aureus* | tst | 18266750: 2118-2822 | 705 | 278 |
| SAUENTK | *Staphylococcus aureus* | EntK | 18266750: 13059-13787 | 729 | 279 |
| SAUENTQ | *Staphylococcus aureus* | EntQ | 18266750: 12265-13035 | 771 | 280 |
| CPNGYRA | *Chlamydia pneumoniae* | GyrA | 28415636: 2451-4955 | 824 | 281 |
| CPNOMPB | *Chlamydia pneumoniae* | OmpB | X53511 | 1030 | 282 |
| CPNMOMPVD4 | *Chlamydia pneumoniae* | MOMP VD4 | M69230 | 150 | 283 |
| CPNMOMPVD2 | *Chlamydia pneumoniae* | major outer membrane protein (MOMP)VD2 | | 133 | 284 |

TABLE 35-continued

RPMV2 Chip Table

| Alias | Organism | Gene Name | Accession Number: Seq Num | Length | SEQ ID NO: |
|---|---|---|---|---|---|
| CPNRPOB | *Chlamydia pneumoniae* | PstI fragment (rpoB) | NT01CP0714 | 346 | 285 |
| CPSOMPA | *Chlamydia psittaci* | OmpA | AF269281 | 991 | 286 |
| CPSSIGA | *Chlamydia psittaci* | SigA | U04442 | 883 | 287 |
| CDIDTX | *Corynebacterium diphtheriae* | Dtx gene | A04646 | 913 | 288 |
| CDIGYRA | *Corynebacterium diphtheriae* | GyrA | 38198900: 8792-11362 | 818 | 289 |
| CDIDTXR | *Corynebacterium diphtheriae* | dtxR gene | M80336 | 1124 | 290 |
| HINGYRA | *Haemophilus influenzae* | GyrA | 1574717: c7221-4579 | 896 | 291 |
| HINOMPA | *Haemophilus influenzae* | OmpP5 (OmpA-family) | L20309 | 937 | 292 |
| LPNGYRA | *Legionella pneumophila* | GyrA | AY091594 | 236 | 293 |
| LPNMOMPS | *Legionella pneumophila* | MompS | AF078136 | 1157 | 294 |
| MCAGYRA | *Moraxella catarrhalis* | GyrA | AF056196 | 321 | 295 |
| MCAHA | *Moraxella catarrhalis* | hemagglutinin | AY077637 | 653 | 296 |
| MTUGYRA | *Mycobacterium tuberculosis* | GyrA | 13879041: 7302-9818 | 818 | 297 |
| MTUOMPA | *Mycobacterium tuberculosis* | OmpA | 38490207: 318539-319519 | 932 | 298 |
| MTURPOB | *Mycobacterium tuberculosis* | RpoB | 468333: 1065-4598 | 411 | 299 |
| MPNGYRA | *Mycoplasma pneumoniae* | GyrA | 11379479: 4821-7340 | 809 | 300 |
| MPNP1 | *Mycoplasma pneumoniae* | P1 gene | AF290002 | 2570 | 301 |
| NMEGYRA | *Neisseria meningitidis* | GyrA | 7413466: 89-2839 | 941 | 302 |
| NMEMVIN | *Neisseria meningitidis* | MviN | 7225498: c5929-4388 | 904 | 303 |
| NMECTRA | *Neisseria meningitides* | capsular transport protein (ctrA) | | 135 | 304 |
| NMECRGA | *Neisseria meningitidis* | CrgA | AF190471 | 254 | 305 |
| AHE16S | *Arcanobacterium hemolyticum* | 16S rRNA | X73952 | 1489 | 306 |
| AHEPLD | *Arcanobacterium hemolyticum* | pld | L16583 | 1111 | 307 |
| BANGYRA | *Bacillus anthracis* | GyrA | AY291534 | 732 | 308 |
| BANLEF | *Bacillus anthracis* | lethal factor | M29081 | 685 | 309 |
| BANPAG | *Bacillus anthracis* | protective antigen | AF306783 | 599 | 310 |
| BANRPOB | *Bacillus anthracis* | rpoB | AF205335 | 777 | 311 |
| BANCYA | *Bacillus anthracis* | Cya | 142812: 544-2946 | 545 | 312 |
| BANCAPB | *Bacillus anthracis* | encapsulation protein gene B(capB) | | 246 | 313 |
| BCERPOB | *Bacillus cereus* | rpoB | AF205342 | 777 | 314 |
| BSUGYRA | *Bacillus subtillus* | GyrA | 40012: 7769-10234 | 812 | 315 |
| BSURPOB | *Bacillus subtillus* | rpoB | AF205356 | 780 | 316 |
| BTHCRY | *Bacillus thuringensis* | cry | AF278797 | 853 | 317 |
| BTHRPOB | *Bacillus thuringensis* | rpoB | AF205349 | 777 | 318 |
| BPEGYRA | *Bordetella pertussis* | GyrA | 33571514: 286253-288934 | 815 | 319 |
| BPEPRNA | *Bordetella pertussis* | PenA | AJ507642 | 777 | 320 |
| BMEGYRA | *Brucella melitensis* (F6145) | GyrA | AE009529: 4650-7358 | 995 | 321 |
| BABRB51 | *Brucella abortus* (RB51) | WboA with insert Consensus Sequence | AF107768 | 1339 | 322 |
| BABOMP25 | *Brucella abortus* (2308 B37) | Omp25 | X79284 | 630 | 323 |
| BABOMP2 | *Brucella abortus* (2308 B37) | Omp2 | U26438 | 1434 | 324 |
| BCAOMP2 | *Brucella canis* | Omp2 | U26439 | 1434 | 325 |
| BMEOMP2 | *Brucella melitensis* (F6145) | Omp2 | U26440 | 1434 | 326 |
| BNEOMP2 | *Brucella neotoma* | Omp2 | U26441 | 1434 | 327 |
| BOVOMP2 | *Brucella ovis* | Omp2 | U26442 | 1449 | 328 |
| BSUIOMP2 | *Brucella suis* (A44) | Omp2 | U26443 | 1434 | 329 |
| BMAPENA | *Burkholderia mallei* (Glanders) | PenA | AY032868 | 1117 | 330 |
| BMAWAAF | *Burkholderia mallei* (Glanders) | WaaF | AY124769 | 1015 | 331 |
| BPSPENA | *Burkholderia pseudomallei* (Meliodosis) | PenA | AY032869 | 1117 | 332 |
| BPSWAAF | *Burkholderia pseudomallei* (Meliodosis) | WaaF | AF097748 | 1100 | 333 |
| BCEPRECA | *Burkholderia cepacia* | RecA | U70431 | 611 | 334 |
| CPEGYRA | *Clostridium perfringens* | GyrA | 18143657: 7100-9391 | 810 | 335 |
| CPETMPC | *Clostridium perfringens* | TmpC | 18146729: c45993-44881 | 1113 | 336 |
| CBUGYRA | *Coxiella burnetii* | GyrA | 29540947: 165494-168040 | 812 | 337 |
| CBUTOLC | *Coxiella burnetii* | TolC | 29540626: 51830-53680 | 745 | 338 |
| FTURD1A | *Francisella tularensis* subsp. *tularensis* strain | RD1-A | 32469331: c985-455 | 531 | 339 |
| FTURD1B | *Francisella tularensis* subsp. *tularensis* strain | RD1-B | 32469331: c1338-1054 | 285 | 340 |
| FTUTUL4 | *Francisella tularensis* | TUL4 | M32059 | 834 | 341 |
| FTUMDH | *Francisella tularensis* | mdh | AF513319 | 960 | 342 |
| FTU13KD | *Francisella tularensis* | 13-kDa protein | M32059 | 431 | 343 |
| FTUFOPA | *Francisella tularensis* | outer membrane protein FopA | | 111 | 344 |
| OTSGROEL | *Orientia tsutsugamushi* | GroEL | AY191589 | 546 | 345 |
| OTSSTA56 | *Orientia tsutsugamushi* | sta56 | AY283180 | 1059 | 346 |
| RPRGYRA | *Rickettsia prowazekii* | GyrA | 3860572: 250672-253389 | 968 | 347 |
| RPROMP1 | *Rickettsia prowazekii* | Omp1 | 3860572: c191770-189464 | 985 | 348 |
| YPEGYRA | *Yersinia pestis* | GyrA | 21959874: c10908-8233 | 812 | 349 |
| YPEOMPA | *Yersinia pestis* | OmpA | 16120353: c1628253-1627192 | 913 | 350 |

TABLE 35-continued

RPMV2 Chip Table

| Alias | Organism | Gene Name | Accession Number: Seq Num | Length | SEQ ID NO: |
|---|---|---|---|---|---|
| YPECVE | Yersinia pestis | cve2155 sequence | AF350077 | 517 | 351 |
| YPECAF1 | Yersinia pestis | caf1 | X61996 | 525 | 352 |
| ACAHAG | Ajellomyces capsulatus | H antigen | U20346 | 1082 | 353 |
| ACAMAG | Ajellomyces capsulatus | M antigen | AF026268 | 919 | 354 |
| ACAGH17 | Ajellomyces capsulatus | GH17 | U27588 | 810 | 355 |
| BDEWI-1 | Blastomyces dermatiditis | WI-1 | S63772 | 942 | 356 |
| BDEBYS1 | Blastomyces dermatiditis | bys1 | AF277079 | 912 | 357 |
| CIMAG2 | Coccidioides immitis | Ag2 | U32518 | 1234 | 358 |
| CIMBG12 | Coccidioides immitis | bg12 | AF022893 | 965 | 359 |
| CPACP2 | Cryptosporidium parvum | CP2 | AY471868 | 735 | 360 |
| CPASOD | Cryptosporidium parvum | Sod | AF529280 | 375 | 361 |
| ECOGYRA | E. coli 0157:H7 | GyrA | 16445223: c3136459-3133832 | 812 | 362 |
| ECOOMPA | E. coli 0157:H7 | OmpA | 12518283: 3562-4221 | 660 | 363 |
| SENGYRA | Salmonella enterica | GyrA | 29136667: 70224-72860 | 812 | 364 |
| SENOMPA | Salmonella enterica | OmpA | 16502231: c18055-17003 | 904 | 365 |
| SDYOMPA | Shigella dysenteriae | OmpA | 46943: 568-1623 | 907 | 366 |
| SFLGYRA | Shigella flexneri | GyrA | 30041918: c2708-81 | 812 | 367 |
| SFLOMPA | Shigella flexneri | OmpA | 24051234: c4458-3340 | 898 | 368 |
| VCHGYRA | Vibrio cholerae | GyrA | 15640032: 1330207-1332891 | 887 | 369 |
| VCHOMPA | Vibrio cholerae | OmpA | 6031221: 1022-1987 | 942 | 370 |
| MSRA | Staphylococcus aureus | MSR(A) | AF467080 | 400 | 371 |
| MECR1 | Staphylococcus aureus | mecR1 | AF142100 | 652 | 372 |
| MEFA | Streptococcus pyogenes | MefA | U70055 | 611 | 373 |
| ERMTR | Streptococcus pyogenes | Erm(TR) | 2190969: 211-942 | 732 | 374 |
| ERMB | Streptococcus pyogenes | ErmB | 38707181: 8545-9307 | 763 | 375 |
| EMRB | Rickettsia prowazekii | EmrB | 3860572: c187837-186278 | 1560 | 376 |
| GYRB | Streptococcus pneumoniae | GyrB | X83917 | 1947 | 377 |
| PARC | Streptococcus pneumoniae | ParC | AF503577 | 2637 | 378 |
| PARE | Streptococcus pneumoniae | parE | 6851036: 1255-3198 | 2008 | 379 |
| PBP1 | Streptococcus pneumoniae | ponA (Pbp1A) | AF446215 | 1282 | 380 |
| PBP5 | Enterococcus faecium | pbp5 | AF375986 | 668 | 381 |
| MECA | Staphylococcus aureus pUB110 | mecA | 9181834: <1-729 | 729 | 382 |
| BLAZ | Staphylococcus aureus plasmid pLW043 | blaz | 33390917: c41981-41136 | 846 | 383 |
| DFRA | Staphylococcus aureus plasmid pLW043 | dfrA | 33390917: c2802-2317 | 486 | 384 |
| VANA | Staphylococcus aureus plasmid pLW043 | vanA | 33390917: 34299-35330 | 1032 | 385 |
| QACC | Staphylococcus aureus plasmid pLW043 | qacC | 33390917: c21313-20990 | 324 | 386 |
| RMTB | Escherichia coli | rmtB | AB117036 | 756 | 387 |
| STRA | Escherichia coli pMBSF1 plasmid | strA | 25815144: 723-1526 | 804 | 388 |
| STRB | Escherichia coli pMBSF1 plasmid | strB | 25815144: 1526-2362 | 837 | 389 |
| AADA1 | Escherichia coli plasmid p541 | aadA1 | 40287459: 10986-11777 | 792 | 390 |
| SULII | Escherichia coli plasmid pSTOJO1 | sulII | 17129524: 449-1264 | 816 | 391 |
| CTXM | Escherichia coli strain EU2657 | ctx-M | AY517475 | 436 | 392 |
| KPC2 | Klebsiella pneumoniae | carbapenemase (KPC-2) | AY034847 | 918 | 393 |
| AMPC | Klebsiella pneumoniae plasmid | AmpC | 40548851: 1310-2449 | 1140 | 394 |
| BLACMY2 | Klebsiella pneumoniae plasmid | bla CMY-2 | 1212997: 1924-3069 | 1146 | 395 |
| AMPR | Klebsiella pneumoniae plasmid pKP3 | AmpR | 40548851: c1199-324 | 876 | 396 |
| SULI | Plasmid R388 | sulI | 45795: 880-1719 | 840 | 397 |
| AACAAPHD | Staphylococcus aureus plasmid pLW043 | aacA-aphD | 33390917: 23440-24879 | 1440 | 398 |
| FLOR | Vibrio cholerae | floR | 32469306: 11605-12819 | 1215 | 399 |
| TETM | Enterococcus faecalis | tet(M) | M85225 | 536 | 400 |
| TETC | Escherichia coli partial plasmid | (tetC) | Y19114 | 502 | 401 |
| TETS | Listeria monocytogenes | tet(S) | L09756 | 555 | 402 |
| TETA | Pseudomonas aeruginosa plasmid RP4 | tet(A) | X75761 | 494 | 403 |
| TETG | Pseudomonas sp. plasmid pPSTG2 | tet(G) | AF133140 | 550 | 404 |
| TETL | Staphylococcus hyicus (plasmid pSTE1) | tet(L) | X60828 | 548 | 405 |
| TETB | Transposon Tn10 | tet(B) | V00611 | 571 | 406 |
| PTX | Bordetella pertussis | Pertussis toxin | M13223 | 872 | 407 |

TABLE 35-continued

RPMV2 Chip Table

| Alias | Organism | Gene Name | Accession Number: Seq Num | Length | SEQ ID NO: |
|---|---|---|---|---|---|
| BONT | Clostridium botulinum | bonT | 3805779: 7268-11143 | 792 | 408 |
| NTNH | Clostridium botulinum | ntnh | 3805779: 3649-7242 | 496 | 409 |
| BOTE | Clostridium botulinum | botE | X62683 | 1000 | 410 |
| EPSILON | Clostridium perfringens plasmid | epsilon-toxin | X60694 | 620 | 411 |
| TETANUS | Clostridium tetani | tetanus toxin | 40769: 281-4228 | 1185 | 412 |
| STX1A | E. coli 0157:H7 | stx1A | 32400301: 1-948 | 948 | 413 |
| STX2A | E. coli 0157:H7 | stx2A | 13359151: 1-960 | 960 | 414 |
| RICINUSTOXIN | Ricinus communis | Ricinus communis toxin | X52908 | 1133 | 415 |
| CTXAB | Vibrio cholerae | ctxA + ctxB | Gary | 984 | 416 |
| PBLUEVEC | pBluescript II KS(+) | | | 236 | 417 |
| PGEMVEC | pGEM-9Zf(−) | | X65312 | 226 | 418 |
| PUCVEC | pUC4KAN | | X06404 | 252 | 419 |
| ATTIM4 | Arabidopsis thaliana(4) | triosephosphate isomerase (TIM) | UZ,51/55 | 523 | 420 |
| | | | | 308034 | |

Example 9

Influenza A Strain Identification with Random RT-PCR Approach

This example is to present application of newly modified random RT-PCR protocol on isolated Influenza A (Fujan/411/2002 strain) nucleic acids spiked into normal nasal wash samples. A random RT-PCR protocol has been applied by DeRisi's lab to amplify viral pathogens for microarray interrogation (Wang et al., 2003). Modification to this protocol was recently reported for amplifying cultured influenza viruses (Kessler et al., 2004). However, the modified protocol was not reported to amplify viral targets in clinical samples.

The Influenza A virus cultures (H1N1 & H3N2) were provided by the Air Force Institute for Operational Health (AFIOH) and sent to Virapure, LLC for amplification and quantification prior to the study. According to the Certificate of Analysis, the virus was amplified for two rounds on early passage MDCK cells purchased from ATCC exclusively for this project, followed by virus amplification in the presence of 1 µg/ml TPCK treated trypsin. At 48 hours after infection, the virus supernatants were collected and adjusted to contain 3% sucrose, 20 mM Tris pH 7.1 and pH stabilizer. Prior to delivery, Corning screw top cryovials were filled with 200-300 µl aliquots of supernatant. The titration of each sample vial was performed according to procedure AM110, Plaque Forming Assay of Influenza Virus. A titer of $1.2 \times 10^7$ PFU/ml was obtained for Influenza A H3N2, K0717 SV5/SV40 RMK and $5 \times 10^6$ PFU/ml for Influenza A/California/2935/03/H1N1.

To generate a clinical collection control, a nasal wash (0.9% Normal Saline) was obtained from an asymptomatic member of the Clinical Division of the Advanced Diagnostic Laboratory at Lackland AFB. From each Virapure pre-quantified titer, a 10-fold/6-series dilution of Influenza-spiked nasal aspirate was generated beginning with and including the Virapure stock of each strain. A total of 100 µl of each influenza-spiked nasal wash were processed from the dilution using the MasterPure Total Nucleic Acid Extraction distributed by EPICENTRE. During the protocol, 150 µl of 2×T and C Lysis Solution containing Proteinase K was added to each 100 µl dilution of the spiked nasal wash, vortex thoroughly and incubated at 65° C. for 15 minutes. Next, the samples were placed on ice for 5 minutes followed by the addition of 150 µl of MPC Protein Precipitation Reagent. The samples were vortex mixed vigorously for 10 seconds. The mixture was then precipitated by centrifugation at 10,000×g for 10 minutes and the supernatant transferred to a microcentrifuge tube. To the recovered supernatant, 500 µl of isopropanol were added and the tube inverted (30-40) times.

The mixture was centrifuged at 4° C. for 10 minutes and the isopropanol decanted without dislodging pellet. Following, the pellet was rinsed twice with 75% ethanol and dried at room temperature. Once dried, the nucleic acid pellet was resuspended in 35 µl of TE Buffer. Each sample was properly labeled and placed in dry ice prior to shipment to the Naval Research Laboratory.

Each of three 100 µl normal nasal wash aliquots was spiked with a serial of dilution (ranging from $10^5$ pfu to $10^1$) of influenza A H3N2 viral cultures. Total nucleic acids were extracted with EPICENTRE MasterPure™ DNA Purification Kits (Madison, Wis.), as in Example 5, and suspended in 40 µl H$_2$O. Random RT-PCR was applied as follows, according to that described (Kessler et al., 2004):

2 µl of total nucleic acid was reverse transcribed by using 1 µl primer D (40 pmol/µl; 5'-GTT TCC CAG TCA CGA TCN NNN NNN NN; SEQ ID NO: 573) and 1 µl Super-Script™ III Reverse Transcriptase (50 units/µl; Invitrogen, Carlsbad, Calif.) in 20 µl. The RT (reverse transcription) reaction was performed at 42° C. for 1 hr and then was inactivated at 70° C. for 15 min. Then 10 µl RT products were amplified with 1 µl primer E (100 pmol/µl; 5'-GTT TCC CAG TCA CGA TC; SEQ ID NO: 574) and 2.5 units TaqPlus Long polymerase (5 units/µl, Stratagene, La Jolla, Calif.) in 50 µl. PCR was conducted with 35 cycles of 94° C. for 30 s, 40° C. for 30 s, 50° C. for 30 s, and 72° C. for 160 s, followed by an additional 7 minutes at 72° C. PCR products from $10^5$, $10^3$ and $10^1$ pfu flu spiking samples were applied to three different V1RPM pathogen microarrays for hybridization according to Affymetrix Customseq protocol.

The V1RPM chip scans for the three spike-in samples, $10^5$, $10^3$, and $10^1$ pfu, amplified by this random RT-PCR method, are shown in FIG. 8 A-C, respectively. All samples resulted in clear sequence calls in at least some of the Influenza A tile regions, indicating that the random RT-PCR protocol successfully amplified flu genomes in the spiking samples even without interference of human genomic DNA. Based on the GDAS outputs (using "permissive" settings), REPI identified the following 4 top "hits" from each sample (Tables 36-38). The top four hits for $10^5$ (Table 36) and $10^3$ pfu (Table 37) samples corresponded to the top ranking being assigned to the correct Fujian/411/2002 strain and were exactly same as those obtained for the Fujian/411/2002 (+) clinical sample NW20031114-05-02 AC1D04-B2, amplified by influenza universal primers (shown in Table 25). This result indicates that random RT-PCR has similar amplification power to the Influenza A-specific PCR with relatively high titer of viruses in the sample. With low titer of flu viruses ($10^1$ pfu), the percentage of tile region that hybridized and the percentage of base calls decreased. This resulted in a slight skewing of the rankings, making Fujian 411/2002 tied for the second highest-ranking strain. However, the V1RPM was still able to read the spiked virus as H3N2 Pretoria strain, which originally derived from and is almost identical to Fujian/411/2002 strain.

Because of success of random RT-PCR in this experiment, it is believed that this protocol will work in flu clinical samples and other pathogenic viruses.

TABLE 36

FluAHA3: Influenza A H3N2 spiked samples ($10^5$ pfu)

| Accession # | Name | E value: | Bit Score: |
|---|---|---|---|
| lcl\|ISDN38157 | InfluenzaA/Fujian/411/2002_Hemagglutinin_104 | 0.0 | 1400.04 |
| gi\|37530025\|gb\|AY389356.1 | Influenza A virus (A/Middleburg/41/03(H3N2)) hemagglutinin (HA) gene | 0.0 | 1400.04 |
| gi\|37530033\|gb\|AY389360.1 | Influenza A virus (A/Pretoria/17/03(H3N2)) hemagglutinin (HA) gene | 0.0 | 1392.11 |
| gi\|37530031\|gb\|AY389359.1 | Influenza A virus (A/Pretoria/16/03(H3N2)) hemagglutinin (HA) gene | 0.0 | 1392.11 |

TABLE 37

FluAHA: Influenza A H3N2 spiked samples ($10^3$ pfu)

| Accession # | Name | E value: | Bit Score: |
|---|---|---|---|
| lcl\|ISDN38157 | InfluenzaA/Fujian/411/2002_Hemagglutinin_104 | 0.0 | 1471.4 |
| gi\|37530025\|gb\|AY389356.1 | Influenza A virus (A/Middleburg/41/03(H3N2)) hemagglutinin (HA) gene | 0.0 | 1471.4 |
| gi\|37530033\|gb\|AY389360.1 | Influenza A virus (A/Pretoria/17/03(H3N2)) hemagglutinin (HA) gene | 0.0 | 1463.47 |
| gi\|37530031\|gb\|AY389359.1 | Influenza A virus (A/Pretoria/16/03(H3N2)) hemagglutinin (HA) gene | 0.0 | 1463.47 |

TABLE 38

FluAHA3: Influenza A H3N2 spiked samples ($10^1$ pfu)

| Accession # | Name | E value: | Bit Score: |
|---|---|---|---|
| gi\|37530033\|gb\|AY389360.1 | Influenza A virus (A/Pretoria/17/03(H3N2)) hemagglutinin (HA) gene | 0.0 | 686.389 |
| gi\|37530031\|gb\|AY389359.1 | Influenza A virus (A/Pretoria/16/03(H3N2)) hemagglutinin (HA) gene | 0.0 | 686.389 |
| gi\|37530029\|gb\|AY389358.1\| | Influenza A virus (A/Pretoria/2/03(H3N2)) hemagglutinin (HA) gene | 0.0 | 686.389 |
| gi\|37530025\|gb\|AY389356.1\| | Influenza A virus (A/Middleburg/41/03(H3N2)) hemagglutinin (HA) gene | 0.0 | 686.389 |
| lcl\|ISDN38157 | InfluenzaA/Fujian/411/2002_Hemagglutinin_104 | 0.0 | 678.459 |

This example is significant because it shows that a completely non-biased amplification method, derived from a June 2001 public domain protocol may be used as a preparative step for resequencing microarrays, resulting in PCR-level sensitivity ($10^1$ target copies). Although this amplification protocol has been used for several published examples of long oligomer (70-mer) microarray-based assays, it is not obvious that it would suffice for resequencing microarray approaches. Numerous modifications and variations on the present invention are possible in light of the above teachings. It is, therefore, to be understood that within the scope of the accompanying claims, the invention may be practiced otherwise than as specifically described herein.

Example 10

Other Pathogen Tests

In summary, the following pathogens were detected/discriminated from laboratory and/or clinical samples on RPMV1, (in aggregate representing >180 chips tested) with 100% concordance of identification and input identity, and with no type cross-hybridizations, except to parts of sequence tiles representing homologous sequences between type variant strains, in:

| | | |
|---|---|---|
| Human adenoviruses group C | Ad5 prototype | Ad5 USA field strain |
| Human adenoviruses group E | Ad4 prototype | Ad4 AF field strain |
| | Ad4 vaccine | Ad4 USN field strain |
| Human adenoviruses group B | Ad3 prototype | Ad3 USN field strain |
| | Ad7 prototype | Ad7 USN field strain |
| | Ad7 vaccine | |
| | Ad16 prototype | |
| | Ad21 prototype | Ad21 field strain |
| Influenza A | H1N1 | H3N2 |
| Variola Major (smallpox) | | |
| Lassa Virus | | |
| Ebola Virus | | |
| Streptococcus pneumonia | | |
| Streptococcus pyogenes | | |
| Chlamydia pneumonia | | |
| Mycoplasma pneumonia | | |
| Neisseria meningitides | | |
| Bacillus anthracis | | |
| Yersinia pestis | | |
| Francisella tularensis | | |

Selected examples of RPMV1 microarray results for prepared non-infectious laboratory samples of Variola Major (smallpox), Ebola Virus, *B. anthracis*, *Y. pestis*, and *F. tularensis* have been performed, but not shown here. Variola Major (smallpox), Ebola Virus, and *F. tularensis* samples were prepared using specific PCR primers. *B. anthracis* and *Y. pestis* samples were amplified using GenomiPhi reagents (as described in Example 3).

Example 11

Features of Sequences Adenoviruses

The following tables present the sequence features and putative gene products for the sequenced adenoviruses appearing in Table 6 and SEQ ID NOs: 575-587.

TABLE 39

Ad3 (Accession No. AY599834; SEQ ID NO: 575) Sequence Features and putative gene products

| Feature Type | Location | Comment or Gene Locus | Product |
|---|---|---|---|
| repeat_region | 1 . . . 134 | | |
| promoter | 480 . . . 485 | "TATA box for the E1A genes" | |
| CDS | Join (576 . . . 662, 1250 . . . 1351) | gene = "E1A" | "6 KD protein" |
| CDS | Join (576 . . . 1155, 1250 . . . 1455) | gene = "E1A" | "29.1 kD protein" |
| CDS | Join (576 . . . 1062, 1250 . . . 1455) | gene = "E1A" | "25K protein" |
| polyA_site | 1494 . . . 1499 | "polyA site for E1A" | |
| promoter | 1549 . . . 1554 | "TATA box for the E1B genes" | |
| CDS | 1603 . . . 2139 | gene = "E1B" | "19 kD small T antigen" |
| CDS | 1908 . . . 3386 | gene = "E1B" | 55K protein |
| Promoter | 3384 . . . 3389 | "TATA box for pIX" | |
| polyA_site | 3450 . . . 3455 | "polyA site for E1B" | |
| CDS | 3480 . . . 3896 | gene = "protein IX" | "protein IX" |
| polyA_site | 3913 . . . 3918 | "polyA site for pIX" | |
| polyA_site | Complement (3925 . . . 3930) | "polyA site for E2B" | |
| CDS | Complement (join (3948 . . . 5281, 5560 . . . 5572)) | gene = "E2B" | "IVA2 maturation protein" |
| CDS | Complement (5051 . . . 8419) | gene = "E2B" | "DNA polymerase" |
| CDS | 5123 . . . 5692 | gene = "hypothetical" | "hypothetical 20.6 KD early protein" |
| Promoter | 5872 . . . 5877 | "TATA box for the Major Late Promoter" | |
| CDS | Complement (6868 . . . 7389) | gene | "hypothetical" = "hypothetical 19 kD protein" |
| CDS | 7829 . . . 8425 | gene = "L1" | "probable DNA binding agnoprotein" |
| CDS | Complement (join (8422 . . . 10389, 13848 . . . 13856)) | gene = "pTP" | "DNA terminal protein precursor" |
| CDS | 9757 . . . 10032 | gene = "hypothetical" | "hypothetical 9.7 kD protein" |
| misc_RNA | 10422 . . . 10595 | "virus-associated RNA I" | |
| CDS | 10890 . . . 12026 | gene = "L1" | "55 KD protein" |

TABLE 39-continued

Ad3 (Accession No. AY599834; SEQ ID NO: 575) Sequence Features and putative gene products

| Feature Type | Location | Comment or Gene Locus | Product |
| --- | --- | --- | --- |
| CDS | 12051 ... 13817 | gene = "L1" | "pIIIa protein" |
| polyA_site | 13830 ... 13835 | "polyA site for L1" | |
| CDS | 13905 ... 15539 | gene = "L2" | "penton base protein" |
| CDS | 15553 ... 16131 | gene = "L2" | "pVII" |
| CDS | 16174 ... 17223 | gene = "L2" | "protein V" |
| polyA_site | 17498 ... 17503 | "polyA site for L2" | |
| CDS | 17555 ... 18001 | gene = "L3" | "protein VI" |
| CDS | 18420 ... 21254 | gene = "L3" | "hexon protein" |
| CDS | 21291 ... 21920 | gene = "L3" | "'23K proteinase'" |
| polyA_site | 21940 ... 21945 | "polyA site for L3" | |
| polyA_site | Complement (21952 ... 21957) | "polyA site for E2A" | |
| CDS | Complement (22006 ... 23559) | gene = "E2A" | "DNA binding protein" |
| CDS | 23590 ... 26076 | gene = "L4" | "hexon assembly-associated 100 KD protein" |
| CDS | 25778 ... 26375 | gene = "L4" | "22K protein" |
| CDS | Join (25778 ... 26159, 26296 ... 26651) | gene = "L4" | "33 KD protein" |
| CDS | 26722 ... 27405 | gene = "L4" | "protein VIII" |
| Promoter | 27087 ... 27092 | "TATA box for the E3 genes" | |
| CDS | 27405 ... 27725 | gene = "E3" | "12.5 KD protein" |
| CDS | 27679 ... 28002 | gene = "E3" | "16 KD glycoprotein" |
| CDS | 28104 ... 28622 | gene = "E3" | "18.5 protein" |
| CDS | 28652 ... 29191 | gene = "E3" | "20.1 KD protein" |
| CDS | 29204 ... 29773 | gene = "E3" | "20.1 KD protein, duplicate copy" |
| CDS | 29788 ... 30021 | gene = "E3" " | "9K glycoprotein" |
| CDS | 30063 ... 30338 | gene = "E3" | "10.3 KD protein" |
| CDS | 30310 ... 30747 | gene = "E3" | "14.9 KD protein" |
| CDS | 30740 ... 31150 | gene = "E3" | "14 KD protein" |
| polyA_site | 31183 ... 31188 | "polyA site for E3" | |
| CDS | Complement (31194 ... 31355) | gene = "U" | "U protein" |
| CDS | 31370 ... 32329 | gene = "L5" | "fiber protein" |
| polyA_site | Complement (32354 ... 32359) | "polyA signal for E4" | |
| CDS | Complement (32370 ... 32621) | gene = "E4" | "ORF6/7" |
| CDS | Complement (32618 ... 33517) | gene = "E4" | "33.2 KD protein" |
| CDS | Complement (33420 ... 33788) | gene = "E4" | "13.6 KD protein" |
| CDS | 33643 ... 34152 | gene = "L5" " | "agnoprotein |
| CDS | Complement (33797 ... 34150) | gene = "E4" | "11 KD protein" |
| CDS | Complement (34147 ... 34536) | gene = "E4" | "14.3 KD protein" |
| polyA_site | 34561 ... 34566 | "polyA signal for L5" | |
| CDS | Complement (34578 ... 34955) | gene = "E4" | "13.9 KD protein" |
| Promoter | Complement (35037 ... 35042) | "TATA box for the E4 promoter" | |
| repeat_region | Complement (35212 ... 35345) | "the inverted terminal repeat" | |

TABLE 40

Ad3FS_navy (Accession No. AY599836; SEQ ID NO: 576) Sequence Features and putative gene products

| Feature Type | Location | Comment or Gene Locus | Product |
| --- | --- | --- | --- |
| repeat_region | 1 ... 111 | "the inverted terminal repeat" | |
| promoter | 480 ... 485 | "TATA box for E1A" | |
| CDS | join (576 ... 647, 1248 ... 1349) | gene = "E1A" | "6.9k protein" |
| CDS | join (576 ... 1062, 1248 ... 1453) | gene = "E1A" | "25K protein" |
| CDS | join (576 ... 1155, 1248 ... 1453) | gene = "E1A" | "29K protein" |
| polyA_site | 1492 ... 1497 | "polyA site for E1A" | |
| promoter | 1547 ... 1552 | "TATA box for E1B" | |
| CDS | 1601 ... 2137 | gene = "E1B" | "19K small T-antigen protein" |
| CDS | 1906 ... 3384 | gene = "E1B" | "55K large T-antigen protein" |
| Promoter | 3428 ... 3433 | "TATA box for pIX" | |
| polyA_site | 3448 ... 3453 | "polyA signal for E1B" | |
| CDS | 3478 ... 3894 | gene = "pIX" | "protein IX" |
| polyA_site | 3907 ... 3912 | "polyA signal for pIX" | |

TABLE 40-continued

Ad3FS_navy (Accession No. AY599836; SEQ ID NO: 576) Sequence Features and putative gene products

| Feature Type | Location | Comment or Gene Locus | Product |
|---|---|---|---|
| polyA_site | complement (3923 . . . 3928) | "polyA signal for E2B" | |
| CDS | complement (join (3946 . . . 5279, 5558 . . . 5570)) | gene = "E2B" | "protein IVa2" |
| CDS | complement(5049 . . . 8417) | gene = "E2B" | "DNA polymerase" |
| Promoter | 5870 . . . 5875 | "TATA box for the Major Late Promoter" | |
| CDS | 6142 . . . 6462 | gene = "hypothetical" | "hypothetical 11.5K early protein" |
| CDS | 7131 . . . 7418 | gene = "hypothetical" | "hypothetical 10.4K early protein" |
| CDS | 7827 . . . 8423 | gene = "L1" | "probable DNA binding agnoprotein" |
| CDS | complement (8227 . . . 8562) | gene = "E2B" | "hypothetical 12.6K early protein" |
| CDS | complement (join (8420 . . . 10378, 13840 . . . 13848)) | gene = "E2B" | "Terminal protein precursor, aka Bellet's protein" |
| CDS | complement (9532 . . . 9846) | gene = "hypothetical" | "11.3K early protein" |
| CDS | 9746 . . . 10021 | gene = "hypothetical" | "9.7K early protein" |
| misc_RNA | 10411 . . . 10584 | "VA RNA I" | |
| misc_RNA | 10662 . . . 10838 | "VA RNA II" | |
| CDS | 10861 . . . 12018 | gene = "L1" | "55K protein" |
| CDS | 12043 . . . 13809 | gene = "L1" | "hexon associated proteinIIIa precursor" |
| polyA_site | 13822 . . . 13827 | "polyA signal for L1" | |
| CDS | 13897 . . . 15531 | gene = "L2" | "penton base protein" |
| CDS | 15545 . . . 16123 | gene = "L2" | "pVII 21K protein" |
| CDS | 16166 . . . 17218 | gene = "L2" | "pV from L2" |
| polyA_site | 17493 . . . 17498 | "polyA signal for L2" | |
| CDS | 17550 . . . 18302 | gene = "L3" | "pVI" |
| CDS | 18415 . . . 21243 | gene = "L3" | "hexon protein" |
| CDS | 21286 . . . 21915 | gene = "L3" | "23K proteinase" |
| polyA_site | 21935 . . . 21940 | "polyA signal for L3" | |
| CDS | complement (21947 . . . 21952) | | |
| CDS | complement (22002 . . . 23552) | "E2A" | "DNA binding protein" |
| CDS | 23583 . . . 26057 | gene = "L4" | "100K protein" |
| CDS | 25759 . . . 26358 | gene = "L4" | "22K protein" |
| CDS | join (25759 . . . 26107, 26289 . . . 26632) | gene = "L4" | "33K protein" |
| CDS | 26702 . . . 27385 | gene = "L4" | "pVIII, hexon associated protein precursor" |
| Promoter | 27067 . . . 27072 | "TATA box for the E3 gene" | |
| CDS | 27385 . . . 27705 | gene = "E3" | "12.2K glycoprotein" |
| CDS | 27659 . . . 28099 | gene = "E3" | "16K glycoprotein" |
| CDS | 28084 . . . 28602 | gene = "E3" | "18.5K glycoprotein" |
| CDS | 28632 . . . 29171 | gene = "E4" | "20.1K glycoprotein" |
| CDS | 29184 . . . 29753 | gene = "E3" | "20.1K glycoprotein" |
| CDS | 29985 . . . 30260 | gene = "E3" | "10.3K glycoprotein" |
| CDS | 30232 . . . 30669 | gene = "E3" | "14.9K glycoprotein" |
| CDS | 30662 . . . 31072 | gene = "E3" | "15.3K protein" |
| polyA_site | 31105 . . . 31110 | "polyA signal for E3" | |
| CDS | complement (31116 . . . 31277) | gene = "U exon" | "U exon protein" |
| CDS | 31292 . . . 32251 | gene = "L5" | "fiber protein" |
| polyA_site | complement (32276 . . . 32281) | "polyA signal for E4" | |
| CDS | complement (32292 . . . 32543) | gene = "E4" | "ORF6/7" |
| CDS | complement (32540 . . . 33439) | gene = "E4" | "34K protein" |
| CDS | complement (33342 . . . 33710) | gene = "E4" | "13.6K protein" |
| CDS | 33565 . . . 34074 | gene = "L5" | "DNA binding agnoprotein" |
| CDS | complement (33719 . . . 34072) | gene = "E4" | "ORF3" |
| CDS | complement (34069 . . . 34458) | gene = "E4" | "14.3K protein" |
| polyA_site | 34483 . . . 34488 | "polyA signal for L5" | |
| CDS | complement (34500 . . . 34877) | gene = "E4" | "13.9K protein" |
| Promoter | complement (34959 . . . 34964) | "TATA box for the E4 gene" | Promoter |
| repeat_region | complement (35155 . . . 35265) | "the inverted terminal repeat" | repeat_region |

TABLE 41

Ad4 (Accession No. AY594253; SEQ ID NO: 577) Sequence Features and putative gene products

| Feature Type | Location | Comment or Gene Locus | Product |
|---|---|---|---|
| repeat_unit | 1 . . . 116 | "ITR" | |
| promoter | 472 . . . 511 | "E1A" | |
| CDS | 576 . . . 1154 | gene = "E1A" | "ORF1: putative" |
| CDS | join (576 . . . 650, 1236 . . . 1340) | gene = "E1A" | "early E1A 6.8 KD protein" similarity to Simian Adenovirus 25 11 kDa, GI: 17227344 |
| CDS | join (576 . . . 1142, 1235 . . . 1441) | gene = "E1A" | "EARLY E1A 28 KD PROTEIN" similarity to Simian Adenovirus 25 28.2 kDa, GI: 17227342 |
| CDS | join (576 . . . 1049, 1235 . . . 1441) | gene = "E1A" | "early E1A 24.6 KD protein" similarity to Simian Adenovirus 25 24.8 kDa, GI: 17227343 |
| polyA_signal | 1499 . . . 1504 | "E1A" | |
| promoter | 1553 . . . 1592 | "E1B" | |
| CDS | join (1600 . . . 2001, 2003 . . . 2029) | gene = "E1B" | "small T-antigen (E1B 19K)" |
| CDS | 1600 . . . 2115 | gene = "E1B" | "early E1B 20 KD protein" similarity to Simian Adenovirus 25 20.5 kDa, GI: 17227345 |
| CDS | join (1905 . . . 2123, 3259 . . . 3276) | gene = "E1B" | "early E1B 8.2 KD protein" similarity to Simian Adenovirus 25 10.1 kDa, GI: 17227348 |
| CDS | 1905 . . . 3356 | gene = "E1B" | "large T antigen" similarity to Simian Adenovirus 25 54.7 kDa, GI: 17227347 |
| CDS | join (1905 . . . 2153, 3141 . . . 3356) | gene = "E1B" | "early E1B 16.8 KD protein" similarity to Simian Adenovirus 25 18.5 kDa, GI: 17227346 |
| CDS | 3441 . . . 3869 | gene = "IX" | "protein IX (hexon-associated protein)" similarity to Simian Adenovirus 25 pIX, GI: 17227349 |
| polyA_signal | 3880 . . . 3885 | "E1B and IX" | |
| polyA_signal | complement (3902 . . . 3907) | "E2B and IVa2" | |
| CDS | complement (join (3930 . . . 5263, 5542 . . . 5554)) | gene = "IVa2" | "IVa2 protein (maturation protein)" similarity to Simian Adenovirus 25 pIVa2, GI: 17227350 |
| CDS | complement (join (5033 . . . 8605, 12212 . . . 12220)) | gene = "E2B(POL)" | "DNA polymerase" similarity to Simian Adenovirus 25 TPA: pol, GI: 33694808 |
| CDS | 5105 . . . 5674 | gene = "E2B" | "19.4 KD early protein" similarity to Human Adenovirus 7 hypothetical 20.6 kD early protein, GI: 58522 |
| CDS | 6126 . . . 6446 | gene = "E2B" | "11.5 KD early protein" similarity to Human Adenovirus 7 hypothtical 11.5 kD early protein, GI: 58524 |
| CDS | 7814 . . . 8407 | gene = "L1" | "DNA-binding protein (agnoprotein)" similarity to Simian Adenovirus 25 21.9 kDa, GI: 17227351 |
| CDS | join (7814 . . . 7819, 8536 . . . 8928) | gene = "E2B" | "14.1 KD early protein" similarity to |

TABLE 41-continued

Ad4 (Accession No. AY594253; SEQ ID NO: 577) Sequence Features and putative gene products

| Feature Type | Location | Comment or Gene Locus | Product |
|---|---|---|---|
| | | | Human Adenovirus 7 hypothetical 14.5 kD early protein, GI: 58528 |
| CDS | complement (join (8404 . . . 10323, 12212 . . . 12220)) | gene = "E2B(pTP)" | "precursor terminal protein" similarity to Simian Adenovirus 25 TPA: pTP, GI: 33694809 |
| misc_RNA | 10356 . . . 10514 | "virus-associated RNA I" | "VA RNA-I, 159 nt" |
| promoter | complement (10457 . . . 10496) | "E2B" | |
| promoter | 10541 . . . 10580 | "L1" | |
| misc_RNA | 10575 . . . 10743 | "virus-associated RNA II" | "VA RNA-II, 169 nt" |
| CDS | 10765 . . . 11937 | gene = "L1(52K)" | "52K protein" similarity to Simian Adenovirus 25 42.9 kDa (52K), GI: 17227352 |
| polyA_signal | 11942 . . . 11947 | "L1(52K)" | |
| CDS | 11961 . . . 13736 | gene = "L1(IIIa)" | "protein IIIa" similarity to Simian Adenovirus 25 TPA: pIIIa, GI: 33694811 |
| polyA_signal | 13749 . . . 13754 | "L1(IIIa)" | |
| promoter | 13758 . . . 13797 | "L2" | |
| CDS | 13815 . . . 15422 | gene = "L2(penton)" | "penton protein (protein III)" similarity to Simian Adenovirus 25 pIII, GI: 17227353 |
| polyA_signal | 15425 . . . 15430 | "L2(penton)" | |
| CDS | 15426 . . . 16007 | gene = "L2(pVII)" | "major core protein (protein VII)" similarity to Simian Adenovirus 25 pVII, GI: 17227354 |
| CDS | 16055 . . . 17080 | gene = "L2(pV)" | "minor core protein (protein V)" similarity to Simian Adenovirus 25 TPA: pV, GI: 33694814 |
| CDS | 17103 . . . 17336 | gene = "L2(pX)" | "protein X (protein mu)" similarity to Simian Adenovirus 25 TPA: pX, GI: 33694815 |
| polyA_signal | 17357 . . . 17362 | "L2(pX)" | |
| CDS | 17368 . . . 18141 | gene = "L3(pVI)" | "protein VI (hexon-associated protein)" similarity to Simian Adenovirus 25 pVI, GI: 17227356 |
| CDS | 18248 . . . 21058 | gene = "L3(hexon)" | "hexon protein (protein II)" similarity to Simian Adenovirus 25 pII (hexon), GI: 17227357 |
| CDS | 21082 . . . 21702 | gene = "L3(23K)" | "late L3 23K proteinase (Adenain)" similarity to Simian Adenovirus 25 protease, GI: 33694818 |
| polyA_signal | 21725 . . . 21730 | "L3" | |
| polyA_signal | complement (21767 . . . 21772) | "E2A" | |
| CDS | complement (21774 . . . 23312) | gene = "E2A(DBP)" | "early E2A DNA-binding protein" similarity to Simian Adenovirus 25 DNA-binding protein, GI: 17227358 |
| CDS | 23341 . . . 25716 | gene = "L4(100K)" | "100K protein" similarity to Simian Adenovirus 25 TPA: 100K, GI: 33694820 |

TABLE 41-continued

Ad4 (Accession No. AY594253; SEQ ID NO: 577) Sequence Features and putative gene products

| Feature Type | Location | Comment or Gene Locus | Product |
|---|---|---|---|
| Promoter | complement (23345 . . . 23384) | "E2A" | |
| CDS | 25439 . . . 25978 | gene = "L4(22K)" | "22K protein" similarity to Simian Adenovirus 25 TPA: 22K, GI: 33694822 |
| CDS | join(25439 . . . 25756, 25926 . . . 26249) | gene = "L4(33K)" | "33K protein" similarity to Simian Adenovirus 25 TPA: 33K (24.3 kDa), GI: 17227359 |
| CDS | 26318 . . . 27001 | gene = "L4(pVIII)" | "L4 protein VIII" similarity to Simian Adenovirus 25 pVIII, GI: 17227360 |
| CDS | 27002 . . . 27322 | gene = "E3" | "E3 12.1 kDa protein" similarity to Simian Adenovirus 25 11.6 kDa, GI: 17227361 |
| CDS | 27276 . . . 27908 | gene = "E3" | "E3 23.3 kDa protein" similarity to Simian Adenovirus 25 TPA: E3 CR1-alpha1, GI: 33694825 |
| CDS | 27890 . . . 28414 | gene = "E3" | "E3 19 kDa protein" similarity to Simian Adenovirus 25 TPA: E3 gp19K (19.3 kDa), GI: 33694826 |
| CDS | 28445 . . . 29107 | gene = "E3" | "E3 24.8 kDa protein" similarity to Simian Adenovirus 25 22.3 kDa, TPA: E3 CR1-gamma1, GI: 17227364 |
| CDS | 29275 . . . 29439 | gene = "E3" | "E3 6.3 kDa protein" |
| CDS | 29436 . . . 30260 | gene = "E3" | "E3 29.7 kDa protein" similarity to Simian Adenovirus 25 TPA: E3 CR1-delta1, GI: 33694829 |
| CDS | 30269 . . . 30544 | gene = "E3" | "E3 10.4 kDa protein" similarity to Simian Adenovirus 25 9.9 kDa, GI: 17227365 |
| CDS | 30550 . . . 30990 | gene = "E3" | "E3 14.5 kDa protein" similarity to Simian Adenovirus 25 15.6 kDa, GI: 17227366 |
| CDS | 30983 . . . 31384 | gene = "E3" | "E3 14.7 kDa protein" similarity to Simian Adenovirus 25 14.7 kDa, GI: 17227367 |
| polyA_signal | 31424 . . . 31429 | "E3" | |
| promoter | 31473 . . . 31512 | "L5" | |
| CDS | 31645 . . . 32922 | gene = "L5(fiber)" | "fiber protein" similarity to Simian Adenovirus 25 pIV (TPA: fiber), GI: 17227368 |
| polyA_signal | 32982 . . . 32987 | "L5" | |
| polyA_signal | complement (32998 . . . 33003) | "E4" | |
| CDS | complement (33018 . . . 33212) | gene = "E4" | "E4 7.4 KD protein" similarity to Simian Adenovirus 25 Ad9 ORF7-like protein, GI: 17227369 |
| CDS | complement (join (33018 . . . 33266, 33992 . . . 34165)) | gene = "E4" | "E4 15.9 KD protein" similarity to Simian Adenovirus 25 TPA: E4 ORF6/7, GI: 33694835 |
| CDS | complement (33266 . . . 34165) | gene = "E4" | "E4 34.6 KD protein" similarity to Simian Adenovirus 25 33 kDa, GI: 17227370 |

TABLE 41-continued

Ad4 (Accession No. AY594253; SEQ ID NO: 577) Sequence Features and putative gene products

| Feature Type | Location | Comment or Gene Locus | Product |
|---|---|---|---|
| CDS | complement (34068 ... 34436) | gene = "E4" | "E4 14.1 KD protein" similarity to Simian Adenovirus 25 13.2 kDa, GI: 17227371 |
| polyA_signal | complement (34388 ... 34393) | "E4" | |
| CDS | complement (34445 ... 34798) | gene = "E4" | "E4 13.7 KD protein" similarity to Simian Adenovirus 25 12.8 kDa, GI: 17227372 |
| CDS | complement (34795 ... 35184) | gene = "E4" | "E4 14.6 KD protein" similarity to Simian Adenovirus 25 14.2 kD, GI: 17227373 |
| CDS | complement (35232 ... 35606) | gene = "E4" | "E4 13.5 KD protein" similarity to Simian Adenovirus 25 TPA: E4 ORF1, GI: 33694840 |
| repeat_unit | complement (35875 ... 35990) | "ITR" | |

TABLE 42

Ad4vaccine (Accession No. AY594254; SEQ ID NO: 578) Sequence Features and putative gene products

| Feature Type | Location | Comment or Gene Locus | Product |
|---|---|---|---|
| repeat_unit | 1 ... 116 | "ITR" | |
| promoter | 472 ... 511 | "E1A" | |
| CDS | 576 ... 1154 | gene = "E1A" | "ORF1: putative" |
| CDS | join (576 ... 650, 1236 ... 1340) | gene = "E1A" | "early E1A 6.8 KD protein" similarity to Simian Adenovirus 25 11 kDa, GI: 17227344 |
| CDS | join (576 ... 1142, 1235 ... 1441) | gene = "E1A" | "early E1A 28 KD protein" similarity to Simian Adenovirus 25 28.2 kDa, GI: 17227342 |
| CDS | join (576 ... 1049, 1235 ... 1441) | gene = "E1A" | "early E1A 24.6 KD protein" similarity to Simian Adenovirus 25 24.8 kDa, GI: 17227343 |
| polyA_signal | 1499 ... 1504 | "E1A" | |
| promoter | 1553 ... 1592 | "E1B" | |
| CDS | Join (1600 ... 2001, 2003 ... 2029) | gene = "E1B" | "small T-antigen (E1B 19K)" |
| CDS | 1600 ... 2115 | gene = "E1B" | "early E1B 20 KD protein" similarity to Simian Adenovirus 25 20.5 kDa, GI: 17227345 |
| CDS | join (1905 ... 2123, 3259 ... 3276) | gene = "E1B" | "early E1B 8.2 KD protein" similarity to Simian Adenovirus 25 10.1 kDa, GI: 17227348 |
| CDS | 1905 ... 3356 | gene = "E1B" | "large T antigen" similarity to Simian Adenovirus 25 54.7 kDa, GI: 17227347 |
| CDS | join (1905 ... 2153, 3141 ... 3356) | gene = "E1B" | "early E1B 16.8 KD protein" similarity to Simian Adenovirus 25 18.5 kDa, GI: 17227346 |
| CDS | 3441 ... 3869 | gene = "IX" | "protein IX (hexon-associated protein)" similarity to Simian Adenovirus 25 pIX, GI: 17227349 |

TABLE 42-continued

Ad4vaccine (Accession No. AY594254; SEQ ID NO: 578) Sequence Features and putative gene products

| Feature Type | Location | Comment or Gene Locus | Product |
|---|---|---|---|
| polyA_signal | 3880 . . . 3885 | "E1B and IX" | |
| polyA_signal | complement (3902 . . . 3907) | "E2B and IVa2" | |
| CDS | complement (join (3930 . . . 5263, 5542 . . . 5554)) | gene = "IVa2" | "IVa2 protein (maturation protein)" similarity to Simian Adenovirus 25 pIVa2, GI: 17227350 |
| CDS | complement (join (5033 . . . 8605, 12212 . . . 12220)) | gene = "E2B(POL)" | "DNA polymerase" similarity to Simian Adenovirus 25 TPA: pol, GI: 33694808 |
| CDS | 5105 . . . 5674 | gene = "E2B" | "19.4 KD early protein" similarity to similar to Human Adenovirus 7 hypothetical 20.6 kD early protein, GI: 58522 |
| CDS | 6126 . . . 6446 | gene = "E2B" | "11.5 KD early protein" similarity to similar to Human Adenovirus 7 hypothtical 11.5 kD early protein, GI: 58524 |
| CDS | 7814 . . . 8407 | gene = "L1" | "DNA-binding protein (agnoprotein)" similarity to Simian Adenovirus 25 21.9 kDa, GI: 17227351 |
| CDS | join (7814 . . . 7819, 8536 . . . 8928) | gene = "E2B" | "14.1 KD early protein" similarity to similar to Human Adenovirus 7 hypothetical 14.5 kD early protein, GI: 58528 |
| CDS | complement (join (8404 . . . 10323, 12212 . . . 12220)) | gene = "E2B(pTP)" | "precursor terminal protein" similarity to Simian Adenovirus 25 TPA: pTP, GI: 33694809 |
| misc_RNA | 10356 . . . 10514 | "virus-associated RNA I" | "VA RNA-I, 159 nt" |
| promoter | complement (10457 . . . 10496) | "E2B" | |
| promoter | 10541 . . . 10580 | "L1" | |
| misc_RNA | 10575 . . . 10743 | "virus-associated RNA II" | "VA RNA-II, 169 nt" |
| CDS | 10765 . . . 11937 | gene = "L1(52K)" | "52K protein" similarity to Simian Adenovirus 25 42.9 kDa (52K), GI: 17227352 |
| polyA_signal | 11942 . . . 11947 | "L1(52K)" | |
| CDS | 11961 . . . 13736 | gene = "L1(IIIa)" | "protein IIIa" similarity to Simian Adenovirus 25 TPA: pIIIa, GI: 33694811 |
| polyA_signal | 13749 . . . 13754 | "L1(IIIa)" | |
| promoter | 13758 . . . 13797 | "L2" | |
| CDS | 13815 . . . 15422 | gene = "L2(penton)" | "penton protein (protein III)" similarity to Simian Adenovirus 25 pIII, GI: 17227353 |
| polyA_signal | 15425 . . . 15430 | "L2(penton)" | |
| CDS | 15426 . . . 16007 | gene = "L2(pVII)" | "major core protein (protein VII)" similarity to Simian Adenovirus 25 pVII, GI: 17227354 |
| CDS | 16055 . . . 17080 | gene = "L2(pV)" | "minor core protein (protein V)" similarity to Simian Adenovirus 25 TPA: pV, GI: 33694814 |

TABLE 42-continued

Ad4vaccine (Accession No. AY594254; SEQ ID NO: 578) Sequence Features and putative gene products

| Feature Type | Location | Comment or Gene Locus | Product |
|---|---|---|---|
| CDS | 17103 . . . 17336 | gene = "L2(pX)" | "protein X (protein mu)" similarity to Simian Adenovirus 25 TPA: pX, GI: 33694815 |
| polyA_signal | 17357 . . . 17362 | "L2(pX)" | |
| CDS | 17368 . . . 18141 | gene = "L3(pVI)" | "protein VI (hexon-associated protein)" similarity to Simian Adenovirus 25 pVI, GI: 17227356 |
| CDS | 18248 . . . 21058 | gene = "L3(hexon)" | "hexon protein (protein II)" similarity to Simian Adenovirus 25 pII (hexon), GI: 17227357 |
| CDS | 21082 . . . 21702 | gene = "L3(23K)" | "late L3 23K proteinase (Adenain)" similarity to Simian Adenovirus 25 protease, GI: 33694818 |
| polyA_signal | 21725 . . . 21730 | "L3" | |
| polyA_signal | complement (21767 . . . 21772) | "E2A" | |
| CDS | complement (21774 . . . 23312) | gene = "E2A(DBP)" | "early E2A DNA-binding protein" similarity to Simian Adenovirus 25 DNA-binding protein, GI: 17227358 |
| CDS | 23341 . . . 25716 | gene = "L4(100K)" | "100K protein" similarity to Simian Adenovirus 25 TPA: 100K, GI: 33694820 |
| promoter | complement (23345 . . . 23384) | "E2A" | |
| CDS | 25439 . . . 25978 | gene = "L4(22K)" | "22K protein" similarity to Simian Adenovirus 25 TPA: 22K, GI: 33694822 |
| CDS | join (25439 . . . 25756, 25926 . . . 26252) | gene = "L4(33K)" | "33K protein" similarity to Simian Adenovirus 25 TPA: 33K (24.3 kDa), GI: 17227359 |
| CDS | 26321 . . . 27004 | gene = "L4(pVIII)" | "L4 protein VIII" similarity to Simian Adenovirus 25 pVIII, GI: 17227360 |
| CDS | 27005 . . . 27325 | gene = "E3" | "E3 12.1 kDa protein" similarity to Simian Adenovirus 25 11.6 kDa, GI: 17227361 |
| CDS | 27279 . . . 27911 | gene = "E3" | "E3 23.3 kDa protein" similarity to Simian Adenovirus 25 TPA: E3 CR1-alpha1, GI: 33694825 |
| CDS | 27893 . . . 28417 | gene = "E3" | "E3 19 kDa protein" similarity to Simian Adenovirus 25 TPA: E3 gp19K (19.3 kDa), GI: 33694826 |
| CDS | 28449 . . . 29111 | gene = "E3" | "E3 24.8 kDa protein" similarity to Simian Adenovirus 25 22.3 kDa, TPA: E3 CR1-gamma1, GI: 17227364 |
| CDS | 29279 . . . 29443 | gene = "E3" | "E3 6.3 kDa protein" |
| CDS | 29440 . . . 30264 | gene = "E3" | "E3 29.7 kDa protein" similarity to Simian Adenovirus 25 TPA: E3 CR1-delta1, GI: 33694829 |
| CDS | 30273 . . . 30548 | gene = "E3" | "E3 10.4 kDa protein" similarity to Simian |

TABLE 42-continued

Ad4vaccine (Accession No. AY594254; SEQ ID NO: 578) Sequence Features and putative gene products

| Feature Type | Location | Comment or Gene Locus | Product |
|---|---|---|---|
| CDS | 30554 . . . 30994 | gene = "E3" | Adenovirus 25 9.9 kDa, GI: 17227365 "E3 14.5 kDa protein" similarity to Simian Adenovirus 25 15.6 kDa, GI: 17227366 |
| CDS | 30987 . . . 31388 | gene = "E3" | "E3 14.7 kDa protein" similarity to Simian Adenovirus 25 14.7 kDa, GI: 17227367 |
| polyA_signal | 31428 . . . 31433 | "E3" | |
| promoter | 31477 . . . 31516 | "L5" | |
| CDS | 31649 . . . 32926 | gene = "L5(fiber)" | "fiber protein" similarity to Simian Adenovirus 25 pIV (TPA: fiber), GI: 17227368 |
| polyA_signal | 32986 . . . 32991 | "L5" | |
| polyA_signal | complement (33002 . . . 33007) | "E4" | |
| CDS | complement (33022 . . . 33216) | gene = "E4" | "E4 7.4 KD protein" similarity to Simian Adenovirus 25 Ad9 ORF7-like protein, GI: 17227369 |
| CDS | complement (join (33022 . . . 33270, 33996 . . . 34169)) | gene = "E4" | "E4 15.9 KD protein" similarity to Simian Adenovirus 25 TPA: E4 ORF6/7, GI: 33694835 |
| CDS | complement (33270 . . . 34169) | gene = "E4" | "E4 34.6 KD protein" similarity to Simian Adenovirus 25 33 kDa, GI: 17227370 |
| CDS | complement (34072 . . . 34440) | gene = "E4" | "E4 14.1 KD protein" similarity to Simian Adenovirus 25 13.2 kDa, GI: 17227371 |
| polyA_signal | complement (34392 . . . 34397) | "E4" | |
| CDS | complement (34449 . . . 34802) | gene = "E4" | "E4 13.7 KD protein" similarity to Simian Adenovirus 25 12.8 kDa, GI: 17227372 |
| CDS | complement (34799 . . . 35188) | gene = "E4" | "E4 14.6 KD protein" similarity to Simian Adenovirus 25 14.2 kD, GI: 17227373 |
| CDS | complement (35236 . . . 35610) | gene = "E4" | "E4 13.5 KD protein" similarity to Simian Adenovirus 25 TPA: E4 ORF1, GI: 33694840 |
| repeat_unit | complement (35879 . . . 35994) | "ITR" | |

TABLE 43

Ad4FS_navy (Accession No. AY599835; SEQ ID NO: 579) Sequence Features and putative gene products

| Feature Type | Location | Comment or Gene Locus | Product |
|---|---|---|---|
| repeat_region | 1 . . . 208 | "ITR" | |
| CDS | 576 . . . 1121 | gene = "E1A" | "ORF1: putative" |
| CDS | Join (576 . . . 650, 1203 . . . 1307) | gene = "E1A" | "early E1A 6.8 KD protein" similarity to similar to Simian Adenovirus 25 11 kDa, GI: 17227344 |
| CDS | join (576 . . . 1109, 202 . . . 1408) | gene = "E1A" | "early E1A 27 KD protein" similarity to Simian Adenovirus 25 28.2 kDa, GI: 17227342 |

TABLE 43-continued

Ad4FS_navy (Accession No. AY599835; SEQ ID NO: 579)
Sequence Features and putative gene products

| Feature Type | Location | Comment or Gene Locus | Product |
|---|---|---|---|
| CDS | join (576 . . . 1016, 202 . . . 1408) | gene = "E1A" | "early E1A 23.5 KD protein" similarity to Simian Adenovirus 25 24.8 kDa, GI: 17227343 |
| polyA_signal | 1464 . . . 1469 | "E1A" | |
| promoter | 1518 . . . 1557 | "E1B" | |
| CDS | Join (1565 . . . 1966, 1968 . . . 1994) | gene = "E1B" | "small T antigen" |
| CDS | 1565 . . . 2119 | gene = "E1B" | "early E1B 21.5 KD protein" standard_name - Simian Adenovirus 25 20.5 kDa, GI: 17227345 |
| CDS | join (1870 . . . 2127, 3263 . . . 3280) | gene = "E1B" | "early E1B 9 KD protein" similarity to Simian Adenovirus 25 10.1 kDa, GI: 17227348 |
| CDS | 1870 . . . 3360 | gene = "E1B" | "large T antigen (55 KD)" similarity to Simian Adenovirus 25 54.7 kDa, GI: 17227347 |
| CDS | join (1870 . . . 2157, 3145 . . . 3360) | gene = "E1B" | "early E1B 17.9 KD protein" similarity to Simian Adenovirus 25 18.5 kDa, GI: 17227346 |
| CDS | 3444 . . . 3872 | gene = "IX" | "protein IX (hexon-associated protein)" |
| polyA_signal | 3882 . . . 3887 | "E1B and IX" | |
| polyA_signal | Complement (3904 . . . 3909) | "E2B and IVa2" | |
| CDS | Complement (join (3935 . . . 5268, 5547 . . . 5559)) | gene = "IVa2" | "IVa2 protein (maturation protein)" |
| CDS | complement (join (5038 . . . 8610, 12152 . . . 12160)) | gene = "E2B (POL)" | "DNA polymerase" |
| CDS | 5110 . . . 5679 | gene = "E2B" | "19.4 KD early protein" similarity to similar to Human Adenovirus 7 htpothetical 20.6 kD early protein, GI: 58522 |
| CDS | 6131 . . . 6451 | gene = "E2B" | "11.5 KD early protein" similarity to similar to Human Adenovirus 7 hypothetical 11.5 kD early protein, GI: 58524 |
| CDS | 7819 . . . 8412 | gene = "L1" | "DNA-binding protein (agnoprotein)" similarity to Simian Adenovirus 25 21.9 kDa, GI: 17227251 |
| CDS | join (7819 . . . 7824, 8541 . . . 8933) | gene = "E2B" | "14.1 KD early protein" similarity to similar to Human Adenovirus 7 hypothetical 14.5 KD early protein, GI: 58528 |
| CDS | complement (join (8409 . . . 10328, 12152 . . . 12160)) | gene = "E2B (pTP)" | "precursor terminal protein" |
| misc_RNA | 10361 . . . 10519 | "virus-associated RNA I" | "VA RNA-I, 159 nt" |
| promoter | complement (10462 . . . 10501) | "E2B" | |
| promoter | 10542 . . . 10581 | "L1" | |
| misc_RNA | 10584 . . . 10684 | "virus-associated RNA II" | "VA RNA-II, 101 nt" |
| CDS | 10705 . . . 11877 | gene = "L1 (52K)" | "52K protein" |
| polyA_signal | 11882 . . . 11887 | "L1 (52K)" | |
| CDS | 11901 . . . 13682 | gene = "L1 (IIIa)" | "protein IIIa" |
| polyA_signal | 13696 . . . 13701 | "L1 (IIIa)" | |
| promoter | 13755 . . . 13794 | "L2" | |

TABLE 43-continued

Ad4FS_navy (Accession No. AY599835; SEQ ID NO: 579)
Sequence Features and putative gene products

| Feature Type | Location | Comment or Gene Locus | Product |
| --- | --- | --- | --- |
| CDS | 13762 ... 15369 | gene = "L2 (penton)" | "penton protein (protein III)" |
| polyA_signal | 15372 ... 15377 | "L2 (penton)" | |
| CDS | 15373 ... 15954 | gene = "L2 (pVII)" | "major core protein (protein VII)" |
| CDS | 16002 ... 17027 | gene = "L2 (pV)" | "minor core protein (protein V)" |
| CDS | 17050 ... 17283 | gene = "L2 (pX)" | "protein X (protein mu)" |
| CDS | 17343 ... 18074 | gene = "L3 (pVI)" | "protein VI (hexon-associated protein)" |
| CDS | 18181 ... 20991 | gene = "L3 (hexon)" | "hexon protein (protein II)" |
| CDS | 21015 ... 21635 | gene = "L3 (23K)" | "23K protease" |
| polyA_signal | 21661 ... 21666 | "L3" | |
| polyA_signal | complement (21703 ... 21708) | "E2A" | |
| CDS | complement (21710 ... 23242) | gene = "E2A (DBP)" | "early E2A DNA-binding protein" |
| promoter | complement (23170 ... 23209) | "E2A" | |
| promoter | 23211 ... 23250 | "L4" | |
| CDS | 23271 ... 25634 | gene = "L4 (100K)" | "100K protein" |
| CDS | 25369 ... 25884 | gene = "L4 (22K)" | "22K protein" |
| CDS | join (25369 ... 25674, 25844 ... 26158) | gene = "L4 (33K)" | "33K protein" |
| CDS | 26226 ... 26909 | gene = "L4 (pVIII)" | "L4 protein VIII" |
| CDS | 26910 ... 27230 | gene = "E3" | "E3 12.1 kDa protein" |
| CDS | 27184 ... 27816 | gene = "E3" | "E3 23.3 kDa protein" |
| CDS | 27798 ... 28322 | gene = "E3" | "E3 19 kDa protein" |
| CDS | 28352 ... 28987 | gene = "E3" | "E3 24.8 kDa protein" |
| CDS | 29296 ... 30105 | gene = "E3" | "E3 29.7 kDa protein" |
| CDS | 30114 ... 30389 | gene = "E3" | "E3 10.4 kDa protein" |
| CDS | 30395 ... 30835 | gene = "E3" | "E3 14.5 kDa protein" |
| CDS | 30828 ... 31229 | gene = "E3" | "E3 14.7 kDa protein" |
| polyA_signal | 31279 ... 31284 | "E3" | |
| promoter | 31292 ... 31331 | "L5" | |
| CDS | 31464 ... 32741 | gene = "L5 (fiber)" | "fiber protein" |
| polyA_signal | 32801 ... 32806 | "L5" | |
| polyA_signal | complement (32817 ... 32822) | "E4" | |
| CDS | complement (32837 ... 33031) | gene = "E4" | "E4 7.4 KD protein" |
| CDS | complement (join (32837 ... 33085, 33811 ... 33984)) | gene = "E4" | "E4 15.9 KD protein" |
| CDS | complement (33085 ... 33984) | gene = "E4" | "E4 34.6 KD protein" |
| CDS | complement (33887 ... 34255) | gene = "E4" | "E4 14.1 KD protein" |
| polyA_signal | complement (34207 ... 34212) | "E4" | |
| CDS | complement (34264 ... 34617) | gene = "E4" | "E4 13.7 KD protein" |
| CDS | complement (34614 ... 35003) | gene = "E4" | "E4 14.6 KD protein" |
| CDS | complement (35051 ... 35425) | gene = "E4" | "E4 13.5 KD protein" |
| repeat_region | complement (35758 ... 35965) | "ITR" | |

TABLE 44

Ad4FS_AF (Accession No. AY599837; SEQ ID NO: 580)
Sequence Features and putative gene products

| Feature Type | Location | Comment or Gene Locus | Product |
| --- | --- | --- | --- |
| repeat_region | 1 ... 208 | "ITR" | |
| CDS | 575 ... 1120 | gene = "E1A" | "ORF1; putative" |
| CDS | Join (575 ... 649, 1202 ... 1306) | gene = "E1A" | "early E1A 6.8 KD protein" similarity to Simian Adenovirus 25 11 kDa, GI: 17227344 |
| CDS | Join (575 ... 1108, 1201 ... 1407) | gene = "E1A" | "early E1A 27 KD protein" similarity to Simian Adenovirus 25 28.2 kDa, GI: 17227342 |
| CDS | Join (575 ... 1015, 1201 ... 1407) | gene = "E1A" | "early E1A 23.5 KD protein" similarity to Simian Adenovirus 25 24.8 kDa, GI: 17227343 |

TABLE 44-continued

Ad4FS_AF (Accession No. AY599837; SEQ ID NO: 580)
Sequence Features and putative gene products

| Feature Type | Location | Comment or Gene Locus | Product |
| --- | --- | --- | --- |
| polyA_signal | 1463 ... 1468 | "E1A" | |
| promoter | 1517 ... 1556 | "E1B" | |
| CDS | join (1564 ... 1965, 1976 ... 1993) | gene = "E1B" | "small T antigen (16.5 KD)" |
| CDS | 1564 ... 2115 | gene = "E1B" | "early E1B 21.5 KD protein" similarity to Simian Adenovirus 25 20.5 kDa, GI: 17227345 |
| CDS | join (1869 ... 2123, 3258 ... 3269) | gene = "E1B" | "early E1B 9 KD protein" similarity to Simian Adenovirus 25 10.1 kDa, GI: 17227348 |
| CDS | join (1869 ... 2615, 2618 ... 3355) | gene = "E1B" | "large T antigen (55 KD)" similarity to Simian Adenovirus 25 54.7 kDa, GI: 17227347 |
| CDS | join (1869 ... 2153, 3140 ... 3355) | gene = "E1B" | "early E1B 17.9 KD protein" similarity to Simian Adenovirus 25 18.5 kDa, GI: 17227346" |
| CDS | 3439 ... 3867 | gene = "IX" | "protein IX (hexon-associated protein)" |
| polyA_signal | 3877 ... 3882 | "E1B and IX" | |
| polyA_signal | complement (3899 ... 3904) | "E2B and IVa2" | |
| CDS | complement (join (3931 ... 5264, 5543 ... 5555)) | gene = "IVa2" | "IVa2 protein (maturation protein)" |
| CDS | complement (join (5034 ... 8606, 12151 ... 12159)) | gene = "E2B (POL)" | "DNA polymerase" |
| CDS | 5106 ... 5675 | gene = "E2B" | "19.4 KD early protein." similarity to similar to Human Adenovirus 7 hypothetical 20.6 kD early protein, GI: 58522 |
| CDS | 6127 ... 6447 | gene = "E2B" | "11.5 KD early protein" similarity to similar to Human Adenovirus 7 hypothtical 11.5 kD early protein, GI: 58524 |
| CDS | 7815 ... 8408 | gene = "L1" | "DNA-binding protein (agnoprotein)" similarity to Simian Adenovirus 25 21.9 kDa, GI: 17227351 |
| CDS | join (7815 ... 7820, 8537 ... 8929) | gene = "E2B" | "14.1 KD early protein" similarity to similar to Human Adenovirus 7 hypothetical 14.5 KD early protein, GI: 58528 |
| CDS | complement (join (8405 ... 10324, 12151 ... 12159)) | gene = "E2B" | "precursor terminal protein" |
| misc_RNA | 10357 ... 10515 | "virus-associated RNA I" | "VA RNA-I, 159 nt" |
| promoter | complement (10458 ... 10497) | "E2B" | |
| promoter | 10541 ... 10580 | "L1" | |
| misc_RNA | 10583 ... 10683 | "virus-associated RNA II" | "VA RNA-II, 101 nt" |
| CDS | 10704 ... 11876 | gene = "L1 (52K)" | "52K protein" |
| polyA_signal | 11881 ... 11886 | "L1 (52K)" | |
| CDS | 11900 ... 13681 | gene = "L1 (IIIa)" | "protein IIIa" |
| polyA_signal | 13695 ... 13700 | "L1 (IIIa)" | |
| promoter | 13754 ... 13793 | "L2" | |
| CDS | 13761 ... 15368 | gene = "L2 (penton)" | "penton protein (protein III)" |
| polyA_signal | 15371 ... 15376 | "L2 (penton)" | |
| CDS | 15372 ... 15953 | gene = "L2 (pVII)" | "major core protein (protein VII)" |
| CDS | 16001 ... 17026 | gene = "L2 (pV)" | "minor core protein (protein V)" |

TABLE 44-continued

Ad4FS_AF (Accession No. AY599837; SEQ ID NO: 580)
Sequence Features and putative gene products

| Feature Type | Location | Comment or Gene Locus | Product |
|---|---|---|---|
| CDS | 17049 . . . 17282 | gene = "L2 (pX)" | "protein X (protein mu)" |
| CDS | 17314 . . . 18072 | gene = "L3 (pVI)" | "protein VI (hexon-associated protein)" |
| CDS | 18179 . . . 20989 | gene = "L3 (hexon)" | "hexon protein (protein II)" |
| CDS | 21013 . . . 21633 | gene = "L3 (23K)" | "L3 23K proteinase (Adenain)" |
| polyA_signal | 21659 . . . 21664 | "L3" | |
| polyA_signal | complement (21701 . . . 21706) | "E2A" | |
| CDS | complement (21708 . . . 23240) | gene = "E2A (DBP)" | "early E2A DNA-binding protein" |
| promoter | complement (23168 . . . 23207) | "E2A" | |
| promoter | 23209 . . . 23248 | "L4" | |
| CDS | 23269 . . . 25632 | gene = "L4 (100K)" | "100K protein" |
| CDS | 25367 . . . 25882 | gene = "L4 (22K)" | "22K protein" |
| CDS | join (25367 . . . 25672, 25842 . . . 26156) | gene = "L4 (33K)" | "33K protein" |
| CDS | 26224 . . . 26907 | gene = "L4 (pVIII)" | "L4 protein VIII" |
| CDS | 26908 . . . 27228 | gene = "E3" | "E3 12.1 kDa protein" |
| CDS | 27182 . . . 27814 | gene = "E3" | "E3 23.3 kDa protein" |
| CDS | 27796 . . . 28320 | gene = "E3" | "E3 19 kDa protein" |
| CDS | 28350 . . . 28985 | gene = "E3" | "E3 24.8 kDa protein" |
| CDS | 29295 . . . 30104 | gene = "E3" | "E3 29.7 kDa protein" |
| CDS | 30113 . . . 30388 | gene = "E3" | "E3 10.4 kDa protein" |
| CDS | 30394 . . . 30834 | gene = "E3" | "E3 14.5 kDa protein" |
| CDS | 30827 . . . 31228 | gene = "E3" | "E3 14.7 kDa protein" |
| polyA_signal | 31278 . . . 31283 | "E3" | |
| promoter | 31291 . . . 31330 | "L5" | |
| CDS | 31463 . . . 32740 | gene = "L5 (fiber)" | "fiber protein" |
| polyA_signal | 32800 . . . 32805 | "L5" | |
| polyA_signal | complement (32816 . . . 32821) | "E4" | |
| CDS | complement (32836 . . . 33030) | gene = "E4" | "E4 7.4 KD protein" |
| CDS | complement (join (32836 . . . 33084, 33810 . . . 33983)) | gene = "E4" | "E4 15.9 KD protein" |
| CDS | complement (33084 . . . 33983) | gene = "E4" | "E4 34.6 KD protein" |
| CDS | complement (33886 . . . 34254) | gene = "E4" | "E4 14.1 KD protein" |
| polyA_signal | complement (34206 . . . 34211) | "E4" | |
| CDS | complement (34263 . . . 34616) | gene = "E4" | "E4 13.7 KD protein" |
| CDS | complement (34613 . . . 35002) | gene = "E4" | "E4 14.6 KD protein" |
| CDS | complement (35050 . . . 35424) | gene = "E4" | "E4 13.5 KD protein" |
| repeat_region | complement (35757 . . . 35964) | "ITR" | |

TABLE 45

Ad5FS (Accession No. AY601635; SEQ ID NO: 581)
Sequence Features and putative gene products

| Feature Type | Location | Comment or Gene Locus | Product |
|---|---|---|---|
| CDS | 11565 . . . 12297 | "52/55K protein gene" | protein_id = "AAA96406.1" |
| CDS | 12318 . . . 14075 | product = "protein IIIa" | protein_id = "AAA96407.1" |
| CDS | 16286 . . . 16474 | product = "protein pVII" | protein_id = "AAA96408.1" |
| CDS | 16544 . . . 17650 | product = "protein V" | protein_id = "AAA96409.1" |
| CDS | 17774 . . . 17920 | product = "protein 5 precursor" | protein_id = "AAA96410.1" |
| CDS | 18003 . . . 18755 | product = "protein pVI" | protein_id = "AAA96411.1" |
| CDS | 25819 . . . 26484 | "100K protein" | protein_id = "AAA96412.1" |
| Exon | 26485 . . . 26514 | "of a 33K protein" | |
| Exon | 26713 . . . 27083 | "of a 33K protein" | |
| CDS | 27174 . . . 27857 | product = "protein pVIII" | protein_id = "AAA96413.1" |

TABLE 46

Ad7 (Accession No. AY594255; SEQ ID NO: 582)
Sequence Features and putative gene products

| Feature Type | Location | Comment or Gene Locus | Product |
| --- | --- | --- | --- |
| repeat_region | 1 ... 108 | "the inverted terminal repeat" | |
| promoter | 481 ... 486 | "TATA box for E1A" | |
| CDS | Join (577 ... 648, 1250 ... 1351) | gene = "E1A" | "6 kD protein" |
| CDS | Join (577 ... 1156, 1250 ... 1455) | gene = "E1A" | "E1A 28 kD protein" |
| CDS | Join (577 ... 1063, 1250 ... 1455) | gene = "E1A" | "mRNAII product, homologue of gi\|209784" |
| polyA_site | 1494 ... 1499 | "polyA site for E1A gene. GenScan Prediction" | |
| promoter | 1549 ... 1554 | "TATA box for E1B" | |
| CDS | 1603 ... 2139 | gene = "E1B" | "19 kD small T antigen, homologous to the unnamed protein product in Ad7, gi\|58518" |
| CDS | 1908 ... 3386 | gene = "E1B" | "55 kD protein, homologous to gi\|58519 in Ad7" |
| CDS | 3144 ... 3386 | gene = "E1B" | "hypothetical protein derived from 1.2 kB mRNA" |
| Promoter | 3384 ... 3389 | "TATA box for proteinIX" | |
| polyA_site | 3405 ... 3410 | "possible polyA site for the E1b genes" | |
| CDS | 3481 ... 3897 | gene = "proteinIX" | "hexon associated protein IX, homologous to the unnamed protein gi\|58521, in Ad7" |
| polyA_site | 3910 ... 3915 | "Genscan predicted polyA site for the proteinIX gene" | |
| polyA_site | complement (3928 ... 3933) | "Genscan predicted polyA site for E2B genes" | |
| CDS | complement (join (3950 ... 5283, 5562 ... 5574)) | gene = "IVa2" | "maturation protein IVA2" |
| CDS | Complement (5053 ... 8421) | gene = "E2B" | "DNA polymerase" |
| Promoter | 5874 ... 5879 | "TATA box for the major late promoter" | |
| CDS | 7987 ... 8427 | gene = "L1" | "DNA binding protein, homologous to protein gi\|17227351 in Adenovirus type E" |
| CDS | complement (8231 ... 8575) | gene = "E2B" | "hypothetical 12.6 kD early protein, gi\|139931 in Ad7" |
| CDS | complement (8424 ... 10346) | gene = "E2B" | "terminal protein precursor, homologue in Ad7 is gi\|74214" |
| CDS | 8550 ... 8951 | gene = "L1" | "hypothetical 14.5 kD protein" |
| CDS | complement (9545 ... 9859) | gene = "E2B" | "11.3 kD early protein, homologue in Ad7 is gi\|139914" |
| CDS | 9759 ... 10034 | gene = "L1" | "9.7 kD hypothetical protein, homologue in Ad7 is gi\|140138" |
| misc_RNA | 10423 ... 10592 | "VA RNA I" | |
| misc_RNA | 10668 ... 10838 | "VA RNA II" | |
| CDS | 10890 ... 12026 | gene = "L1" | "55 kD protein" |
| CDS | 12051 ... 13817 | gene = "L1" | "peripentonal hexon associated protein IIIa" |
| polyA_site | 13830 ... 13835 | "Genscan predicted polyA site for L1" | |
| CDS | 13905 ... 15539 | gene = "L2" | "penton base protein (III)" |
| polyA_site | 15545 ... 15550 | "Genscsan predicted polyA site for L2" | |
| CDS | 15550 ... 16128 | gene = "L2" | "protein VII precursor" |
| CDS | 16171 ... 17000 | gene = "L2" | "minor core protein, protein V" |
| polyA_site | 17497 ... 17502 | "Genscan predicted polyA site for L2" | |

TABLE 46-continued

Ad7 (Accession No. AY594255; SEQ ID NO: 582)
Sequence Features and putative gene products

| Feature Type | Location | Comment or Gene Locus | Product |
| --- | --- | --- | --- |
| CDS | 17554 ... 18306 | gene = "L3" | "protein VI precursor" |
| CDS | 18419 ... 21232 | gene = "L3" | "hexon protein" |
| CDS | 21269 ... 21898 | gene = "L3" | "23K protease" |
| polyA_site | 21918 ... 21923 | "Genscan predicted polyA site for L3" | |
| polyA_site | complement (21930 ... 21935) | "Genscan predicted polyA site for E2A" | |
| CDS | complement (21985 ... 23538) | gene = "E2A" | "DNA binding protein" |
| CDS | 23569 ... 26055 | gene = "L4" | "100k hexon-assembly associated protein" |
| CDS | complement (24924 ... 25133) | gene = "hypothetical" | "hypothetical protein" |
| CDS | 25757 ... 26356 | gene = "L4" | "22K protein" |
| CDS | join (25850 ... 26225, 26275 ... 26630) | gene = "L4" | "33 kD protein" |
| polyA_site | 26662 ... 26667 | "possible polyA site for the L4 gene" | |
| CDS | 26700 ... 27383 | gene = "L4" | "protein VIII, hexon-associated protein precursor" |
| Promoter | 27065 ... 27070 | "TATA box for E3" | |
| CDS | 27383 ... 27703 | gene = "E3" | "12.1 kD glycoprotein" |
| CDS | 27657 ... 28097 | gene = "E3" | "16.1 kD protein" |
| CDS | 28082 ... 28600 | gene = "E3" | "19.3 kD MHC classI antigen-binding glycoprotein precursor" |
| CDS | 28630 ... 29169 | gene = "E3" | "hypothetical 20.6 kD protein" |
| CDS | 29182 ... 29751 | gene = "E3" | "20.6 kD protein" |
| CDS | 29766 ... 29966 | gene = "E3" | "7.7 kD protein" |
| CDS | 30083 ... 30313 | gene = "E3" | "10.3 kD protein" |
| CDS | 30285 ... 30722 | gene = "E3" | "14.9 kD protien" |
| CDS | 30715 ... 31122 | gene = "E3" | "14.7 kD protein" |
| polyA_site | 31128 ... 31133 | "Genscan predicted polyA site for E3" | |
| CDS | complement (31141 ... 31305) | gene = "" | "U protein" |
| CDS | 31320 ... 32297 | gene = "L5" | "fiber protein" |
| polyA_site | complement (32317 ... 32322) | "Genscan prediction for polyA site of E4" | |
| CDS | complement (32333 ... 32584) | gene = "E4" | "orf 6/7 protein" |
| CDS | complement (32581 ... 33480) | gene = "E4" | "33.2 kD protein" |
| CDS | complement (33383 ... 33751) | gene = "E4" | "13.6 kD protein" |
| CDS | 33606 ... 34115 | gene = "L5" | "agnoprotein" |
| CDS | complement (33760 ... 34113) | gene = "E4" | "34 kD protein" |
| CDS | complement (34110 ... 34499) | gene = "E4" | "130aa protein" |
| polyA_site | 34122 ... 34127 | "possible polyA site for the L5 gene" | |
| CDS | complement (34541 ... 34918) | gene = "E4" | "13.9 kD protein" |
| Promoter | complement (35000 ... 35005) | "TATA box for E4" | |
| repeat_region | complement (35199 ... 35306) | "the inverted terminal repeat" | |

TABLE 47

Ad7FS_navy (Accession No. AY601634; SEQ ID NO: 583)
Sequence Features and putative gene products

| Feature Type | Location | Comment or Gene Locus | Product |
| --- | --- | --- | --- |
| repeat_region | 0 ... 135 | "the inverted terminal repeat" | |
| promoter | 479 ... 484 | "TATA box for E1A" | |
| CDS | 575 ... 1168 | gene = "E1A" | "hypothetical E1A protein" |
| CDS | join (575 ... 646, 1249 ... 1350) | gene = "E1A" | "6 KD protein" |
| CDS | join (575 ... 1154, 1249 ... 1454) | gene = "E1A" | "mRNAI, 28 KD E1A protein" |
| CDS | join (575 ... 1061, 1249 ... 1454) | gene = "E1A" | "mRNAII protein" |
| polyA_signal | 1493 ... 1498 | "polyA signal for E1A gene" | |
| promoter | 1548 ... 1553 | "TATA box for E1B" | |

TABLE 47-continued

Ad7FS_navy (Accession No. AY601634; SEQ ID NO: 583)
Sequence Features and putative gene products

| Feature Type | Location | Comment or Gene Locus | Product |
|---|---|---|---|
| CDS | 1602 . . . 2138 | gene = "E1B" | "20 KD small T antigen" |
| CDS | 1907 . . . 3385 | gene = "E1B" | "transformation associated 55 KD protein" |
| Promoter | 3383 . . . 3388 | "TATA box for proteinIX" | |
| polyA_signal | 3401 . . . 3406 | "possible polyA signal for E1B gene" | |
| CDS | 3479 . . . 3895 | gene = "pIX" | "proteinIX" |
| polyA_signal | 3908 . . . 3913 | "polyA signal for the proteinIX gene" | |
| polyA_signal | complement (3926 . . . 3931) | "possible polyA signal for E2B genes" | |
| CDS | complement (join (5560 . . . 5572, 3948 . . . 5281) | gene = "E2B" | "maturation protein IVa2" |
| CDS | complement (5051 . . . 8419) | gene = "E2B" | "DNA polymerase" |
| Promoter | 5872 . . . 5877 | "TATA box for the major late promoter" | |
| CDS | 6144 . . . 6464 | gene = "hypothetical" | "hypothetical protein A-106" |
| CDS | complement (6868 . . . 7389) | gene = "E2B" | "hypothetical 19 KD protein" |
| CDS | 7133 . . . 7420 | gene = "L1" | "hypothetical 10.4 KD protein" |
| CDS | 7829 . . . 8425 | gene = "L1" | "15.3 KD agnoprotein" |
| CDS | complement (8328 . . . 8573) | gene = "E2B" | "hypothetical 12.6 kD early protein" |
| CDS | complement (8422 . . . 10344) | gene = "E2B" | "preterminal DNA-binding protein" |
| CDS | 8548 . . . 8949 | gene = "hypothetical" | "hypothetical 14.5 KD early protein" |
| CDS | 9757 . . . 10032 | gene = "hypothetical" | "hypothetical 9.7 KD protein" |
| Misc_RNA | 10424 . . . 10584 | "VA RNA I", | |
| Misc_RNA | 10655 . . . 10829 | "VA RNA II" | |
| CDS | 10806 . . . 11975 | gene = L1" | "55 KD protein" |
| CDS | 12000 . . . 13766 | gene = "L1" | "peripentonal hexon associated protein IIIA" |
| polyA_signal | 13779 . . . 13784 | "polyA signal for L1" | |
| CDS | 13854 . . . 15488 | gene = "L2" | "penton base protein" |
| CDS | 15500 . . . 16078 | gene = "L2" | "major core protein precursor pVII" |
| CDS | 16121 . . . 17173 | gene = "L2" | "minor core protein precursor pV" |
| polyA_signal | 17448 . . . 17453 | "possible polyA signal for L2" | |
| CDS | 17505 . . . 18239 | gene = "L3" | "pVI precursor" |
| CDS | 18352 . . . 21156 | gene = "L3" | "the hexon protein" |
| CDS | 21193 . . . 21822 | gene = "L3" | "23 KD proteinase" |
| polyA_signal | 21842 . . . 21847 | "possible polyA signal for L3" | |
| polyA_signal | complement (21854 . . . 21859) | "possible polyA signal for E2A" | |
| CDS | complement (21911 . . . 23464) | gene = "E2A" | "DNA binding protein" |
| CDS | 23495 . . . 25984 | gene = "L4" | "100 KD protein" |
| CDS | 25686 . . . 26285 | gene = "L4" | "22 KD protein" |
| CDS | join (25686 . . . 26034, 26204 . . . 26559) | gene = "L4" | "33 KD protein" |
| CDS | 26719 . . . 27312 | gene = "L4" | "pVIII protein" |
| Promoter | 26994 . . . 26999 | "putative TATA box for the E3 gene" | |
| CDS | 27312 . . . 27632 | gene = "E3A" | "12.1 KD glycoprotein" |
| polyA_signal | 27391 . . . 27396 | "possible polyA signal for L4" | |
| CDS | 27586 . . . 28026 | gene = "E3A" | "16.1 KD protein" |
| CDS | 28011 . . . 28529 | gene = "E3A" | "19 KD MHC classI antigen-binding glycoprotein" |
| CDS | 28559 . . . 29083 | gene = "E3A" | "20.3 KD glycoprotein" |
| CDS | 29110 . . . 29679 | gene = "E3A" | "20.3 KD protein" |
| CDS | 29694 . . . 29819 | gene = "E3A" | "7.7 KD protein" |

TABLE 47-continued

Ad7FS_navy (Accession No. AY601634; SEQ ID NO: 583)
Sequence Features and putative gene products

| Feature Type | Location | Comment or Gene Locus | Product |
|---|---|---|---|
| CDS | 29931 ... 30206 | gene = "E3B" | "10.3 KD protein" |
| CDS | 30178 ... 30615 | gene = "E3B" | "14.9 KD protein" |
| CDS | 30608 ... 31015 | gene = "E3B" | "15.3 KD protein" |
| polyA_signal | 31021 ... 31026 | "putative polyA signal for E3" | |
| CDS | 31213 ... 32190 | gene = "L5" | "fiber protein" |
| polyA_signal} | complement (32209 ... 32214) | "polyA signal for the E4 gene" | |
| CDS | complement (32225 ... 32476) | gene = "E4" | "ORF6/7" |
| CDS | complement (32473 ... 33372) | gene = "E4" | "32 KD protein" |
| CDS | complement (33275 ... 33643) | gene = "E4" | "13.6 KD protein" |
| CDS | 33498 ... 34007 | gene = "L5" | "agnoprotein" |
| CDS | complement (33652 ... 34005) | gene = "E4" | "13 KD protein" |
| CDS | complement (34002 ... 34391) | gene = "E4" | "130aa protein |
| CDS | complement (34433 ... 34810) | gene = "E4" | "13.9 KD protein" |
| Promoter | complement (34891 ... 24896) | "possible TATA box for the E4 gene" | |
| repeat_region | complement (35062 ... 35197) | "the inverted terminal repeat" | |

TABLE 48

Ad7vaccine (Accession No. AY594256; SEQ ID NO: 584)
Sequence Features and putative gene products

| Feature Type | Location | Comment or Gene Locus | Product |
|---|---|---|---|
| misc_feature | 1 ... 136 | "the inverted terminal repeat" | |
| promoter | 476 ... 481 | "TATA box for the E1A genes" | |
| CDS | join (572 ... 647, 1247 ... 1348) | gene = "E1A" | "E1A 6 kD protein" |
| CDS | join (572 ... 1157, 1246 ... 1452) | gene = "E1A" | "E1A mRNA I protein, homologous to the 29.1 kD protein in Ad11" |
| CDS | join (572 ... 1067, 1246 ... 1452) | gene = "E1A" | "E1A mRNA II protein, homologous to the 25.7 kD E1A protein in Ad 11" |
| polyA_site | 1490 ... 1495 | | |
| promoter | 1545 ... 1550 | "TATA box for E1B" | |
| CDS | 1599 ... 2136 | gene = "E1B" | "20 kd protein, small T antigen" |
| CDS | 1904 ... 3382 | gene = "E1B" | "55 kD protein" |
| promoter | 3380 ... 3385 | "TATA box for pIX" | |
| CDS | 3476 ... 3892 | gene = "pIX" | "protein IX" |
| polyA_site | 3905 ... 3910 | | |
| polyA_site | complement (3923 ... 3928) | | |
| CDS | complement (join (3945 ... 5278, 5557 ... 5569)) | gene = "E2B" | "pIVA2" |
| CDS | complement (5048 ... 8416) | gene = "E2B" | "DNA polymerase" |
| promoter | 5869 ... 5874 | "TATA box for the major late promoter" | |
| CDS | 6141 ... 6461 | gene = "hypothetical" | "A-106 hypothetical protein" |
| CDS | 7826 ... 8422 | gene = "agnoprotein gene" | "13.6 kD agnoprotein" |
| CDS | complement (8419 ... 10341) | gene = "E2B" | "DNA terminal protein" |
| CDS | complement (9540 ... 9854) | gene = "hypothetical" | "11.3 kD hypothetical protein" |
| CDS | 9754 ... 10029 | gene = "hypothetical" | "protein = 9.7 kD hypothetical protein" |
| misc_RNA | 10403 ... 10821 | "VA RNA, SHORTENED DUE TO A 25 bp DELETION" | "VA RNA" |
| CDS | 10828 ... 11997 | gene = "L1" | "55 kD protein" |
| CDS | 12022 ... 13788 | gene = "L1" | "pIIIA precursor" |
| CDS | 13876 ... 15510 | "L2" | "penton protein III precursor" |
| polyA_site | 15512 ... 15517 | | |

TABLE 48-continued

Ad7vaccine (Accession No. AY594256; SEQ ID NO: 584)
Sequence Features and putative gene products

| Feature Type | Location | Comment or Gene Locus | Product |
|---|---|---|---|
| CDS | 15520 . . . 16098 | gene = "L2" | "protein VII precursor" |
| CDS | 16141 . . . 17193 | gene = "L2" | "protein V" |
| polyA_site | 17467 . . . 17472 | | |
| CDS | 17523 . . . 18275 | gene = "L3" | "protein VI precursor" |
| CDS | 18388 . . . 21192 | gene = "L3" | "hexon" |
| CDS | 21229 . . . 21858 | gene = "L3" | "23K protease" |
| polyA_site | 21878 . . . 21883 | | |
| polyA_site | complement (21890 . . . 21895) | | |
| CDS | complement (21947 . . . 23500) | gene = "E2A" | "DNA binding protein" |
| CDS | 23531 . . . 26020 | gene = "L4" | "hexon protein" |
| CDS | 25722 . . . 26321 | gene = "L4" | "33 KD protein" |
| CDS | join (25722 . . . 26070, 26252 . . . 26595) | gene = "L4" | "33 kD protein" |
| CDS | 26665 . . . 27348 | gene = "L4" | "pIII protein" |
| promoter | 27030 . . . 27035 | "TATA box for E3" | |
| CDS | 27348 . . . 27668 | gene = "E3" | "12.1 kD glycoprotein" |
| CDS | 27622 . . . 28062 | gene = "E3" | "16.1 kD protein" |
| CDS | 28047 . . . 28565 | gene = "E3" | "18.3 kD glycoprotein precursor" |
| CDS | 28595 . . . 29134 | gene = "E3" | "E3 20.1 kD protein" |
| CDS | 29147 . . . 29716 | gene = "E3" | "E3 20.6 kD protein duplication" |
| CDS | 29731 . . . 29856 | gene = "E3" | "E3 7.7 kD protein" |
| CDS | 29969 . . . 30244 | gene = "E3" | "E3 10.3 kD protein" |
| CDS | 30249 . . . 30653 | gene = "E3B" | "E3B 14.9 kD protein precursor" |
| CDS | 30646 . . . 31053 | gene = "E3B" | "E3B 14.7 kD protein" |
| polyA_site | 31059 . . . 31064 | | |
| CDS | 31251 . . . 32228 | gene = "L5" | "L5 fiber protein" |
| polyA_site | complement (32247 . . . 32252) | | |
| CDS | complement (32263 . . . 32514) | gene = "E4" | "E4 orf6/7" |
| polyA_site | 32764 . . . 32769 | | |
| CDS | complement (33313 . . . 33681) | gene = "E4" | "E4 13.6 kD protein" |
| CDS | 33536 . . . 34045 | gene = "probable agnoprotein gene" | "probable agnoprotein" |
| CDS | complement (33690 . . . 34043) | gene = "E4" | "E4 13 kD protein" |
| CDS | complement (34040 . . . 34429) | gene = "E4" | "13.9 kD protein" |
| CDS | complement (34471 . . . 34848) | gene = "E4" | "hypothetical protein" |

TABLE 49

Ad16 (Accession No. AY594256; SEQ ID NO: 585)
Sequence Features and putative gene products

| Feature Type | Location | Comment or Gene Locus | Product |
|---|---|---|---|
| repeat_region | 1 . . . 114 | "the inverted terminal repeat" | |
| promoter | 478 . . . 483 | "TATA box of the E1 promoter" | |
| CDS | join (574 . . . 645, 1247 . . . 1348) | gene = "E1A" | "6.3 kDa protein" |
| CDS | join (574 . . . 1060, 1247 . . . 1452) | gene = "E1A" | "25.7 kDa protein" |
| CDS | join (574 . . . 1153, 1247 . . . 1452) | gene = "E1A" | "28 kDa protein" |
| polyA_signal | 1489 . . . 1494 | "polyA signal for E1A" | |
| promoter | 1544 . . . 1549 | "TATA box for the E1B gene" | |
| CDS | 1598 . . . 2134 | gene = "E1B" | "19K small T-antigen protein" |
| CDS | 1903 . . . 3381 | gene = "E1B" | "55K large T antigen protein" |
| promoter | 3444 . . . 3449 | "TATA box for pIX" | |
| CDS | 3476 . . . 3892 | gene = "pIX" | "proteinIX" |
| polyA_signal | 3905 . . . 3910 | "polyA signal for pIX" | |
| polyA_signal | complement (3923 . . . 3928) | "polyA signal for E2B" | |
| CDS | complement (join (3945 . . . 5278, 5557 . . . 5569)) | gene = "E2B" | "maturation protein pIVa2" |
| CDS | complement (5048 . . . 8416) | gene = "E2B" | "DNA polymerase" |
| promoter | 5869 . . . 5874 | "TATA box for the Major Late Promoter" | |

TABLE 49-continued

Ad16 (Accession No. AY594256; SEQ ID NO: 585)
Sequence Features and putative gene products

| Feature Type | Location | Comment or Gene Locus | Product |
|---|---|---|---|
| CDS | 7130 ... 7417 | gene = "hypothetical" | "hypothetical 10.4K early protein" |
| CDS | 7826 ... 8422 | gene = "hypothetical" | "probable DNA binding agnoprotein" |
| CDS | complement (8226 ... 8570) | gene = "E2B" | "hypothetical 12.6K early protein" |
| CDS | complement (join (8419 ... 10386, 13843 ... 13851)) | gene = "E2B" | "Terminal protein precursor" |
| CDS | 10851 ... 12020 | gene = "L1" | "55K protein" |
| CDS | 12045 ... 13811 | gene = "L1" | "protein IIIa precursor" |
| polyA_signal | 13825 ... 13830 | "polyA signal for L1" | |
| CDS | 13902 ... 15569 | gene = "L2" | "penton base protein" |
| CDS | 15582 ... 16160 | gene = "L2" | "protein VII precursor" |
| CDS | 16203 ... 17255 | gene = "L2" | "32K proteinV" |
| CDS | 17284 ... 17511 | gene = "L2" | "proteinX" |
| polyA_signal | 17529 ... 17534 | "polyA signal for L2" | |
| CDS | 17586 ... 18284 | gene = "L3" | "protein VI precursor" |
| CDS | 18450 ... 21272 | gene = "L3" | "the hexon protein" |
| CDS | 21309 ... 21938 | gene = "L3" | "23K protease" |
| polyA_signal | 21958 ... 21963 | "polyA signal for L3" | |
| polyA_signal | complement (21970 ... 21975) | "polyA signal for E2A" | |
| CDS | complement (22027 ... 23580) | gene = "E2A" | "early DNA binding protein" |
| CDS | 23611 ... 26097 | gene = "L4" | "100k protein" |
| CDS | 25799 ... 26398 | gene = "L4" | "22K protein" |
| CDS | join (25799 ... 26147, 26317 ... 26672) | "33K protein" | gene = "L4" |
| CDS | 26742 ... 27425 | gene = "L4" | "protein VIII precursor" |
| promoter | 27107 ... 27112 | "TATA box for E3" | |
| CDS | 27425 ... 27745 | gene = "E3A" | "12.2K glycoprotein" |
| CDS | 27699 ... 28139 | gene = "E3A" | "16.1K membrane protein" |
| polyA_signal | 27734 ... 27739 | "possible polyA signal for L4" | |
| CDS | 28124 ... 28642 | gene = "E3" | "18.5K glycoprotein precursor" |
| CDS | 28672 ... 29211 | gene = "E3" | "20.1K protein" |
| CDS | 29224 ... 29793 | gene = "E3" | "20.5K glycoprotein" |
| CDS | 29808 ... 30023 | gene = "E3" | "7.7K protein" |
| CDS | 30133 ... 30408 | gene = "E3" | "10.3K protein" |
| CDS | 30380 ... 30817 | gene = "E3" | "14.9K protein" |
| CDS | 30810 ... 31217 | gene = "E3" | "14.7K protein" |
| polyA_signal | 31258 ... 31263 | "polyA signal for E3" | |
| CDS | complement (31269 ... 31433) | gene = "U" | "U exon protein" |
| CDS | 31448 ... 32509 | gene = "L5" | "the fiber protein" |
| polyA_signal | complement (31735 ... 31740) | "polyA signal for E4" | |
| polyA_signal | 32520 ... 32525 | "possible polyA signal for L5" | |
| CDS | complement (32552 ... 32803) | gene = "E4" | "ORF6/7" |
| CDS | complement (32800 ... 33696) | gene = "E4" | "34K protein" |
| CDS | complement (33599 ... 33967) | gene = "E4" | "13.6K protein" |
| CDS | 33822 ... 34331 | gene = "L5" | "DNA binding agnoprotein" |
| CDS | complement (33976 ... 34329) | gene = "E4" | "13K protein" |
| CDS | complement (34326 ... 34715) | gene = "E4" | "14.3K protein" |
| CDS | complement (34757 ... 35134) | gene = "E4" | "13.9K protein" |
| promoter | complement (35216 ... 35221) | "TATA box for E4" | |
| repeat_region | complement (35409 ... 35522) | "the inverted terminal repeat" | |

TABLE 50

Ad1 (Accession No. AF534906; SEQ ID NO: 586)
Sequence Features and putative gene products

| Feature Type | Location | Comment or Gene Locus | Product |
|---|---|---|---|
| CDS | join (560 ... 1112, 1230 ... 1546) | gene = "E1a" | "32 kDa protein" |
| CDS | join (560 ... 976, 1232 ... 1546) | gene = "E1a" | "26 kDa protein" |

TABLE 50-continued

Ad1 (Accession No. AF534906; SEQ ID NO: 586)
Sequence Features and putative gene products

| Feature Type | Location | Comment or Gene Locus | Product |
|---|---|---|---|
| CDS | join (560 . . . 643, 1236 . . . 1319) | gene = "E1a" | "6 kDa protein" |
| CDS | 1717 . . . 2259 | gene = "E1a" | "21 kDa protein" |
| CDS | 2022 . . . 3524 | gene = "E1b" | "transformation-associated protein 55 kDa" |
| CDS | join (2022 . . . 2270, 3291 . . . 3524) | gene = "E1b" | "E1b" |
| CDS | join (2022 . . . 2270, 3233 . . . 3277) | gene = "E1b" | "E1b" |
| CDS | 3621 . . . 4043 | gene = "IX" | "hexon-associated protein 14.5 kDa" |
| CDS | complement (4102 . . . 5460) | gene = "IVa2" | "virion morphogenesis-associated protein 51 kDa" |
| CDS | complement (5208 . . . 8378) | gene = "IVa2" | "DNA polymerase 120 kDa" |
| CDS | 7989 . . . 8438 | gene = "L1" | "16.7 kDa protein" |
| CDS | complement (8594 . . . 10552) | gene = "E2b" | "terminal protein 75 kDa" |
| CDS | complement (10598 . . . 10996) | "unknown" | "47 kDa protein" |
| CDS | 11059 . . . 12306 | gene = "L1" | "47 kDa protein" |
| CDS | 12327 . . . 14084 | gene = "IIIa" | "peripentonal hexon-associated protein 65 kDa" |
| CDS | 14166 . . . 15890 | gene = "L3_1" | "penton protein 64 kDa" |
| CDS | 15897 . . . 16493 | gene = "pro-VII" | "major core protein 22 kDa precursor" |
| CDS | 16563 . . . 17669 | gene = "pV" | "minor core protein 42 kDa" |
| CDS | 17793 . . . 17939 | gene = "L2" | "pmu 8.8 kDa" |
| CDS | 18022 . . . 18774 | gene = "pVI" | "hexon-associated protein 27 kDa precursor" |
| CDS | 18861 . . . 21755 | gene = "L4" | "hexon protein 109 kDa" |
| CDS | 21788 . . . 22402 | gene = "L3_1" | "endopeptidase 23 kDa" |
| CDS | complement (22500 . . . 24089) | gene = "E2a_1" | "DNA-binding protein 59 kDa" |
| CDS | 24118 . . . 26541 | gene = "L5" | "hexon assembly-associated protein 90 kDa" |
| CDS | join (26252 . . . 26566, 26769 . . . 27137) | gene = "E2a_2" | "virion morphogenesis-associated protein 25 kDa" |
| CDS | 27225 . . . 27908 | gene = "pVIII" | "hexon-associated protein 25 kDa" |
| CDS | 27909 . . . 28232 | gene = "E3A" | "12 kDa protein" |
| CDS | 28775 . . . 29257 | gene = "E3" | "glycosylated membrane protein 18.6 kDa" |
| CDS | 29532 . . . 29816 | gene = "E3" | "10.7 kDa protein" |
| CDS | 30106 . . . 30507 | gene = "E3" | "14.9 kDa protein" |
| CDS | 31101 . . . 32849 | gene = "L5" | "fiber protein 62 kDa" |
| CDS | complement (join (33976 . . . 34063, 34768 . . . 34865, 35232 . . . 35594)) | gene = "E4" | "20 kDa protein" |
| CDS | complement (join (33976 . . . 34063, 34768 . . . 35054, 35232 . . . 35594)) | gene = "E4" | "27 kDa protein" |
| CDS | complement (join (33976 . . . 34063, 34768 . . . 35168, 35232 . . . 35594)) | gene = "E4" | "32 kDa protein" |
| CDS | complement (join (34764 . . . 34865, 35232 . . . 35594)) | gene = "E4" | "17 kDa protein" |
| CDS | complement (join (34764 . . . 35054, 35232 . . . 35594)) | gene = "E4" | "24 kDa protein" |
| CDS | complement (join (34764 . . . 35168, 35232 . . . 35594)) | gene = "E4" | "28.6 kDa protein" |

TABLE 51

Ad21 (Accession No. AY601633; SEQ ID NO: 587)
Sequence Features and putative gene products

| Feature Type | Location | Comment or Gene Locus | Product |
|---|---|---|---|
| repeat_unit | 1 . . . 114 | "ITR" | |
| CDS | join (574 . . . 645, 1247 . . . 1348) | gene = "E1A" | "E1A 6.8 KD protein" |
| CDS | join (574 . . . 1155, 1249 . . . 1452) | gene = "E1A" | "E1A 28.4 KD protein" |

TABLE 51-continued

Ad21 (Accession No. AY601633; SEQ ID NO: 587)
Sequence Features and putative gene products

| Feature Type | Location | Comment or Gene Locus | Product |
|---|---|---|---|
| CDS | join (574 . . . 1062, 1249 . . . 1452) | gene = "E1A" | "E1A 24.6 KD protein" |
| polyA_signal | 1491 . . . 1496 | "E1A" | |
| promoter | 1541 . . . 1580 | "E1B and IX" | |
| CDS | 1905 . . . 3383 | gene = "E1B" | "E1B large T antigen" |
| CDS | 3477 . . . 3893 | gene = "IX" | "protein IX (hexon-associated protein)" |
| polyA_signal | 3906 . . . 3911 | "E1B and IX" | |
| polyA_signal | complement (3924 . . . 3929) | "E2B and IVa2" | |
| CDS | complement (join (3946 . . . 5279, 5558 . . . 5570)) | gene = "IVa2" | "IVa2 protein (maturation protein)" |
| CDS | complement (5049 . . . 8417) | gene = "E2B (POL)" | "DNA polymerase" |
| CDS | 6142 . . . 6462 | gene = "unassigned" | "hypothetical 11.5 KD protein" |
| CDS | complement (6866 . . . 7387) | gene = "unassigned" | "hypothetical 19 KD protein" |
| CDS | 7131 . . . 7418 | gene = "unassigned" | "hypothetical 10.4 KD protein" |
| CDS | join (7827 . . . 8228, 9478 . . . 9495) | gene = "unassigned" | "DNA binding protein" |
| CDS | complement (8227 . . . 8571) | gene = "unassigned" | "hypothetical 12.6 KD protein" |
| CDS | complement (8420 . . . 10342) | gene = "E2B (pTP)" | "DNA terminal protein" |
| CDS | 8546 . . . 8947 | gene = "unassigned" | "hypothetical 14.5 KD protein" |
| CDS | complement (9541 . . . 9855) | gene = "unassigned" | "hypothetical 11.5 KD protein" |
| CDS | 9755 . . . 10030 | gene = "unassigned" | "hypothetical 9.7 KD protein" |
| promoter | complement (10521 . . . 10560) | "E2B and IVa2" | |
| promoter | 10576 . . . 10615 | "L1" | |
| CDS | 10857 . . . 12026 | gene = "L1 (52K)" | "L1 52K protein" |
| CDS | 12054 . . . 13805 | gene = "L1 (IIIa)" | "protein IIIa" |
| CDS | 13878 . . . 15563 | gene = "L2 (penton)" | "penton protein (protein III)" |
| polyA_signal | 15565 . . . 15570 | "L2 (penton)" | |
| CDS | 15572 . . . 16150 | gene = "L2 (pVII)" | "major core protein (protein VII)" |
| CDS | 16190 . . . 17251 | gene = "L2 (pV)" | "minor core protein (protein V)" |
| CDS | 17280 . . . 17510 | gene = "L2 (pX)" | "protein X (protein mu)" |
| polyA_signal | 17528 . . . 17533 | "L2 (X)" | |
| promoter | 17542 . . . 17581 | "L3" | |
| CDS | 17583 . . . 18332 | gene = "L3 (pVI)" | "protein VI (hexon-associated protein)" |
| CDS | 18454 . . . 21303 | gene = "L3 (hexon)" | "hexon protein (protein II)" |
| CDS | 21340 . . . 21969 | gene = "L3 (23K)" | "23K proteinase (Adenain)" |
| polyA_signal | 21989 . . . 21994 | "L3" | |
| polyA_signal | complement (22001 . . . 22006) | "E2A" | |
| CDS | complement (22058 . . . 23611) | gene = "E2A (DBP)" | "early E2A DNA-binding protein" |
| promoter | complement (23560 . . . 23599) | "E2A" | |
| promoter | 23601 . . . 23641 | "L4" | |
| CDS | 23642 . . . 26113 | gene = "L4 (100K)" | "100K protein" |
| CDS | 25815 . . . 26414 | gene = "L4 (22K)" | "22K protein" |
| CDS | join (25815 . . . 26163, 26354 . . . 26688) | gene = "L4 (33K)" | "33K protein" |
| polyA_signal | 26559 . . . 26564 | "L4 (100K and 22K)" | |
| CDS | 26758 . . . 27441 | gene = "L4 (pVIII)" | "L4 protein VIII" |
| CDS | 27441 . . . 27761 | gene = "E3" | "E3 12.1 KD protein" |
| CDS | 27715 . . . 28155 | gene = "E3" | "E3 16 KD protein" |
| polyA_signal | 27750 . . . 27755 | "E3" | |
| CDS | 28140 . . . 28658 | gene = "E3" | "E3 19.2 KD protein" |
| CDS | 28688 . . . 29227 | gene = "E3" | "E3 20 KD protein" |
| CDS | 29240 . . . 29827 | gene = "E3" | "E3 21.2 KD protein" |
| CDS | 29857 . . . 30084 | gene = "E3" | "E3 8.8 KD protein" |
| CDS | 30124 . . . 30399 | gene = "E3" | "E3 10.3 KD protein" |
| CDS | 30371 . . . 30808 | gene = "E3" | "E3 16.6 KD protein" |
| CDS | 30801 . . . 31208 | gene = "E3" | "E3 15.3 KD protein" |
| CDS | 31406 . . . 32377 | gene = "L5 (fiber)" | "fiber protein" |
| polyA_signal | 32380 . . . 32385 | "L5" | |

TABLE 51-continued

Ad21 (Accession No. AY601633; SEQ ID NO: 587)
Sequence Features and putative gene products

| Feature Type | Location | Comment or Gene Locus | Product |
|---|---|---|---|
| polyA_signal | complement (32397 . . . 32402) | "E4" | |
| CDS | complement (join (32409 . . . 32660, 33383 . . . 33556)) | gene = "E4" | "E4 16 KD protein" |
| CDS | complement (32657 . . . 33556) | gene = "E4" | "E4 34.7 KD protein" |
| CDS | complement (33459 . . . 33827) | gene = "E4" | "E4 14.3 KD protein" |
| CDS | 33682 . . . 34191 | gene = "unassigned" | "agonoprotein" similarity to Human Adenovirus B agonoprotein, GI: 32967054 |
| CDS | complement (33836 . . . 34189) | gene = "E4" | "E4 13.6 KD protein" |
| CDS | complement (34186 . . . 34575) | gene = "E4" | "E4 14.4 KD protein" |
| CDS | complement (34617 . . . 34994) | gene = "E4" | "E4 14.2 KD protein" |
| repeat_unit | complement (35269 . . . 35382) | "ITR" | |

For the products designated above in Tables 39-51, the present inventors note that it is routine in the art by referring to the universal genetic code to translate the nucleic acid sequence identified in the "location" column to the corresponding amino acid sequence. As such, the amino acid sequences designated in the "product" column have not been explicitly listed.

REFERENCES

Albert, T. J., Norton, J., Ott, M., Richmond, T., Nuwaysir, K., Nuwaysir, E. F., Stengele, K. P., Green, R. D. 2003. Light-directed 5'→3' synthesis of complex oligonucleotide microarrays. *Nucleic Acids Res* 31:e35

Bohlander, S. K., Espinosa, R., 3rd, Le Beau, M. M., Rowley, J. D., Diaz, M. O. 1992. A method for the rapid sequence-independent amplification of microdissected chromosomal material. *Genomics* 13:1322-4

Cherkasova, E., Laassri, M., Chizhikov, V., Korotkova, E., Dragunsky, E., Agol, V. I., Chumakov, K. 2003. Microarray analysis of evolution of RNA viruses: evidence of circulation of virulent highly divergent vaccine-derived polioviruses. *Proc Natl Acad Sci USA* 100:9398-403

Chizhikov, V., Rasooly, A., Chumakov, K., Levy, D. D. 2001. Microarray analysis of microbial virulence factors. *Appl Environ Microbiol* 67:3258-63

Cutler, D. J., Zwick, M. E., Carrasquillo, M. M., Yohn, C. T., Tobin, K. P., Kashuk, C., Mathews, D. J., Shah, N. A., Eichler, E. E., Warrington, J. A., Chakravarti, A. 2001. High-throughput variation detection and genotyping using microarrays. *Genome Res* 11: 1913-25

Devereux, J., Haeberli, P., Smithies, O. 1984. A comprehensive set of sequence analysis programs for the VAX. *Nucleic Acids Res* 12:387-95

Ferguson, J. A., Steemers, F. J., Walt, D. R. 2000. High-density fiber-optic DNA random microsphere array. *Anal Chem* 72:5618-24

Ginger, D. S., Zhang, H., Mirkin, C. A. 2004. The evolution of dip-pen nanolithography. *Angew Chem Int Ed Engl* 43:30-45

Gingeras, T. R., Ghandour, G., Wang, E., Berno, A., Small, P. M., Drobniewski, F., Alland, D., Desmond, E., Holodniy, M., Drenkow, J. 1998. Simultaneous genotyping and species identification using hybridization pattern recognition analysis of generic *Mycobacterium* DNA arrays. *Genome Res* 8:435-48

Gingeras, T. R., Mack, D., Chee, M. S., Berno, A. J., Small, P. M., Drobniewski, F., Alland, D., Desmond, E., Holodniy, M., Drenkow, J. 2001. Chip-Based Species Identification and Phenotype Characterization of Microorganisms. Affymetrix, Inc., US Hoffmann, E., Stech, J., Guan, Y., Webster, R. G., Perez, D. R. 2001. Universal primer set for the full-length amplification of all influenza A viruses. *Arch Virol* 146:2275-89

Kampke, T., Kieninger, M., Mecklenburg, M. 2001. Efficient primer design algorithms. *Bioinformatics* 17:214-25

Kessler, N., Ferraris, O., Palmer, K., Marsh, W., Steel, A. 2004. Use of the DNA Flow-Thru Chip, a Three-Dimensional Biochip, for Typing and Subtyping of Influenza Viruses. *J Clin Microbiol* 42:2173-2185

Korf, I., Yandell, M., Bedell, J. 2003. BLAST. O'Reilly and Associates, Sebastopol, Calif.

Kozal, M. J., Shah, N., Shen, N., Yang, R., Fucini, R., Merigan, T. C., Richman, D, D., Morris, D., Hubbell, E., Chee, M., Gingeras, T. R. 1996. Extensive polymorphisms observed in HIV-1 clade B protease gene using high-density oligonucleotide arrays. *Nat Med* 2:753-9

Lee, C. 2003. Generating consensus sequences from partial order multiple sequence alignment graphs. *Bioinformatics* 19:999-1008

Lin, B., Vora, G. J., Thach, D., Walter, E., Metzgar, D., Tibbetts, C., Stenger, D. A. 2004. Rapid detection and serotyping of acute respiratory disease-associated adenoviruses with oligonucleotide microarrays. *Journal of Clinical Microbiology* in press Meinkoth, J., Wahl, G. 1984. Hybridization of nucleic acids immobilized on solid supports. *Anal Biochem* 138:267-84

Needleman, S. B., Wunsch, C. D. 1970. A general method applicable to the search for similarities in the amino acid sequence of two proteins. *J Mol Biol* 48:443-53

Nuwaysir, E. F., Huang, W., Albert, T. J., Singh, J., Nuwaysir, K., Pitas, A., Richmond, T., Gorski, T., Berg, J. P., Ballin, J., McCormick, M., Norton, J., Pollock, T., Sumwalt, T., Butcher, L., Porter, D., Molla, M., Hall, C., Blattner, F., Sussman, M. R., Wallace, R. L., Cerrina, F., Green, R. D. 2002. Gene expression analysis using oligonucleotide arrays produced by maskless photolithography. *Genome Res* 12:1749-55

Ochman, H., Lawrence, J. G., Groisman, E. A. 2000. Lateral gene transfer and the nature of bacterial innovation. *Nature* 405:299-304

Offringa, D. P., Tyson-Medlock, V., Ye, Z., Levandowski, R. A. 2000. A comprehensive systematic approach to identification of influenza A virus genotype using RT-PCR and RFLP. *J Virol Methods* 88:15-24

Strizhkov, B. N., Drobyshev, A. L., Mikhailovich, V. M., Mirzabekov, A. D. 2000. PCR amplification on a microarray of gel-immobilized oligonucleotides: detection of bacterial toxin- and drug-resistant genes and their mutations. *Biotechniques* 29:844-8, 850-2, 854 passim Troesch, A., Nguyen, H., Miyada, C. G., Desvarenne, S., Gingeras, T. R., Kaplan, P. M., Cros, P., Mabilat, C. 1999. Mycobacterium species identification and rifampin resistance testing with high-density DNA probe arrays. *J Clin Microbiol* 37:49-55

Vasiliskov, A. V., Timofeev, E. N., Surzhikov, S. A., Drobyshev, A. L., Shick, V. V., Mirzabekov, A. D. 1999. Fabrication of microarray of gel-immobilized compounds on a chip by copolymerization. *Biotechniques* 27:592-4, 596-8, 600 passim Volokhov, D., Chizhikov, V., Chumakov, K., Rasooly, A. 2003. Microarray analysis of erythromycin resistance determinants. *J Appl Microbiol* 95:787-98

Vora, G. J., Meador, C. E., Stenger, D. A., Andreadis, J. D. 2004. Nucleic Acid amplification strategies for DNA microarray-based pathogen detection. *Appl Environ Microbiol* 70:3047-54

Wang, D., Coscoy, L., Zylberberg, M., Avila, P. C., Boushey, H. A., Ganem, D., DeRisi, J. L. 2002. Microarray-based detection and genotyping of viral pathogens. *Proc Natl Acad Sci USA* 99:15687-92

Wang, D., Urisman, A., Liu, Y. T., Springer, M., Ksiazek, T. G., Erdman, D. D., Mardis, E. R., Hickenbotham, M., Magrini, V., Eldred, J., Latreille, J. P., Wilson, R. K., Ganem, D., DeRisi, J. L. 2003. Viral discovery and sequence recovery using DNA microarrays. *PLoS Biol* 1:E2

Wilson, K. H., Wilson, W. J., Radosevich, J. L., DeSantis, T. Z., Viswanathan, V. S., Kuczmarski, T. A., Andersen, G. L. 2002a. High-density microarray of small-subunit ribosomal DNA probes. *Appl Environ Microbiol* 68:2535-41

Wilson, W. J., Strout, C. L., DeSantis, T. Z., Stilwell, J. L., Carrano, A. V., Andersen, G. L. 2002b. Sequence-specific identification of 18 pathogenic microorganisms using microarray technology. *Mol Cell Probes* 16:119-27

Yang, I. V., Chen, E., Hasseman, J. P., Liang, W., Frank, B. C., Wang, S., Sharov, V., Saeed, A. I., White, J., Li, J., Lee, N. H., Yeatman, T. J., Quackenbush, J. 2002. Within the fold: assessing differential expression measures and reproducibility in microarray assays. *Genome Biol* 3:research0062

---

SEQUENCE LISTING (587 sequences)

SEQ ID NO: 1 - DNA, 699 bp, Influenza A virus
ttgagaagaatgtgacagtgacacactctgtcaacctacttgaggacagtcacaacggaaaactatgtctactaaaaggaatagccccactacaattgggtaattgcagcgttgccggatggatcttaggaaacccagaatgcgaattactgatttccaaggaatcatggtcctacattgtagaaacaccaaatcctgagaatggaacatgttacccagggtatttcgccgactatgaggaactgagggagcaattgagttcagtatcttcatttgagagattcgaaatattccccaaagaaagctcatggcccaaccacaccgtaaccggagtatcagcatcatgctcccataatgggaaaagcagtttttacagaaatttgctatggctgacggggaagaatggtttgtacccaaacctgagcaagtcctatgtaaacaacaaagagaaagaagtccttgtactatggggtgttcatcacccgcctaacataggggaccaaagggccctctatcatacagaaaatgcttatgtctctgtagtgtcttcacattatagcagaagattcaccccagaaatagccaaaagacccaaagtaagagatcaggaaggaagaatcaactactactggactctgctggaacctggggatacaataatatttgaggcaaatggaaatctaatagcgccatggtatg

SEQ ID NO: 2 - DNA, 794 bp, Influenza A virus
gatagtgaaaacaatcacgaatgaccaaattgaagttactaatgctactgagctggttcagagttcctcaacaggtggaatatgcgacagtcctcatcagatccttgatggagaaaactgcacactaatagatgctctattgggagaccctcagtgtgatggcttccaaaataagaaatgggacctttttgttgaacgcagcaaagcctacagcaactgttacccttatgatgtgccggattatgcctcccttaggtcactagttgcctcatccggcacactggagtttaacaatgaaagcttcaattgggctggagtcactcagaatggaacaagctctgcttgcaaaaggagatctaataaaagtttctttagtagattgaattggttgacccacttaaaatacaaatacccagcattgaacgtgactatgccaaacaatgaaaaatttgacaaattgtacatttggggggttcaccacccgggtacggacagtgaccaaatcagcctatatgctcaagcatcaggaagaatcacagtctctaccaaaagaagccaacaaactgtaatcccgaatatcggatctagacccagggtaagggatgtctccagcagaataagcatctattggacaatagtaaaaccgggagacatacttttgattaacagcacagggaatctaattgctcctcggggttacttcaaaatacgaagtgggaaaagctcaataatgagatcagatgcacccattggcaaatgcaattctgaatgcatcactccaaatggaagcattc

SEQ ID NO: 3 - DNA, 524 bp, Influenza A virus
aatccactcaaaaggcaatagatggagtcaccaataaggtcaactcgatcattaacaaaatgaacactcagtttgaggccgttggaagggaatttaataacttagaaaggagaatagagaatttaaacaagaaaatggaagacggattcctagatgtctggacttacaatgctgaacttctggttctcatggaaaatgagagaactctcgactttcatgactcaaatgtcaagaacctttacgacaaggtccgactacagcttagggataatgcaaaggaactgggtaatggttgtttcgaattctatcacaaatgtgataatgaatgtatggaaagtgtaaaaaacggaacgtatgactacccgcagtattcagaagaagcaagactaaacagagaggaaataagtggagtaaaattggaatcaatgggaacttaccaaatactgtcaatttattcaacagtggcgagttccctagcactggcaatcatggtagctggtctatctttatggatgtgctccaat

SEQ ID NO: 4 - DNA, 1360 bp, Influenza A virus
aaaagcaggagtttaaaatgaatccaaatcagaaaataataaccattggatcaatctgtatgacaatcggaataattagtctaatattgcaaataggaaatattatttcaatatgggttagccactcaatccaaactggaagtcaaaaccacactggaatatgcaaccaaagaatcattacttatgaaaatagcacctgggtaaatcaaacatatgtcaatattaacaacactaacgttgttgctggaaaggacacaacttcagtgacattagccggcaattcatctctttgtcctatccgtgggtgggctatatacagcaaagacaacagcataagaattggttccaaaggagatgtttttgtcataagagaaccttttatatcatgttctcacttggaatgcagaaccttttttctgacccaaggtgctctattaaatgacaagcattcaaatgggaccgttaaggacagaagcccttatagggccttaatgagctgtcctataggtgaagctccgtctccatacaattcaaggtttgaatcagttgcttggtcagcaagcgcatgtcatgatggcatgggctggctaacaatcggaatttctggtccagatgatggagcagtggctgtactaaaatacaacggcataataactgaaaccataaaaagttggaggaagcgaatattaagaacacaagagtctgaatgtgtctgtgtaaacggttcatgttttaccataatgaccgatggcccgagtaatggacctgcctcgtacagaatcttcaaaatcgagaaggggaagattactaaatcaatagagttggatgcacccaattctcattacgaggaatgttcctgttacccagacaccggcacagtgatgtgtgtgtgcagagacaattggcatggttcgaatcgaccttgggtgtcttttaatcaaaacctggattatcaaataggatacatctgcagtggggttttcggtgacaatccgcgtcccaaagatggaaaaggcagctgtgatccagtaactgttgatggagcagacggagtaaaggggttttcatacaggtatggtaatggtgtttggataggaaggactaaaagtaacagctccagaaagggatttgagatgatttgggatcctaatggatggacagataccgatagtaatttcttagtgaaacaggatgtagtggcaatgactgattggtcagggtacagcggaagtttcgttcaacatcctgagctaacaggattggactgtatgaggccttgcttctgggttgaattaatcagaggacgacctagagaaaagacaacaatctggactagtgggagcagcatttctttttgtgg

SEQ ID NO: 5 - DNA, 1449 bp, Influenza A virus
gcaaaagcaggagtgaaaatgaatccaaatcaaaagataataacgattggctctgtttctctcactattgccacaatatgcttccttatgcaaatagccatcctggtaactactgtaacattgcatttcaagcaatatgaatgcaactcccccccaaacaaccaagtaatgctgtgtgaaccaacaataatagaaagaaacataacagagatagtgtatctgaccaacaccaccatagagaaggaaatatgccccaaactagcagaatacagaaattggtcaaagccgcaatgtaaaattacaggatttgcacctttttctaaggataattcaattcggctttccgctggtggggacatttgggtgacaagagaaccttatgtgtcatgcgatcctgacaagtgttatcaatttgcccttggacagggaacaacactaaacaacaggcattcaaatgacacagtacatgataggaccccttatcgaaccctattgatgaatgagttgggtgttccatttcatttgggaaccaagcaagtgtgtatagcatggtccagctcaagttgtcacgatggaaaagcatggctgcatgtttgtgtaactgggcatgatgaaaatgcaactgctagcttcatttacgatgggagacttgtagatagtattggttcatggtccaaaaaaatcctcaggacccaggagtcggaatgcgtttgtatcaatggaacttgtacagtagtaatgactgatgggagtgcttcaggaagagctgatactaaaatacttttcattgaggaggggaaaatcgttcatactagcaaattgtcaggaagtgctcagcatgtcgaggagtgctcctgttatcctcgatatcctggtgtcagatgtgtctgcagagacaactggaaaggctccaataggcccatcgtagatataaatgtaaaggattatagcattgtttccagttatgtgtgctcaggacttgttggagacacacccagaaaaaacgacagctccagcagtagccattgcctggatcctaacaatgaagaagggggtcatggagtgaaaggctgggcctttgatgatggaaatgacgtgtggatgggaagaacgatcagcgagaagtcacgctcaggttatgaaaccttcaaggtcattgaaggctggtccaaacctaactccaaattgcagataaataggcaagtcatagttgaaagaggtaatatgtccggttattctggtattttctctgttgaaggcaaaagctgcatcaatcggtgcttttatgtggagttgataaggggaaggaaacaggaaactgaagtctggtggacctcaaacagtattgttgtgttttgtggcacctcaggtacatatggaacaggctcatggcctgatggggcggacatcaatctcatgcctatataagctttcgcaattttagaaaaa

SEQ ID NO: 6 - DNA, 923 bp, Influenza A virus
agcaaaagcaggtagatattgaaagatgagtcttctaaccgaggtcgaaacgtacgttctctctatcgtcccgtcaggccccctcaaagccgagatcgcacagagacttgaagatgtctttgcagggaagaacaccgatcttgaggttctcatggaatggctaaagacaagaccaatcctgtcacctctgactaaggggattttaggatttgtgttcacgctcaccgtgcccagtgagcggggactgcagcgtagacgctttgtccaaaatgctcttaatgggaacggagatccaaataacatggacaaagcagttaaactgtataggaagcttaagagggagataacattccatggggccaaagaaatagcactcagttattctgctggtgcacttgccagttgtatgggcctcatatacaacaggatgggggctgtggccactgaagtggcatttggcctggtatgcgcaacctgtgaacagattgctgactcccagcatcggtctcataggcaaatggtgacaacaaccaatccactaatcagacatgagaacagaatggttctagccagcactacagctaaggctatggagcaaatggctggatcgagtgagcaagcagcagaggccatggatattgctagtcaggccaggcaaatggtgcaggcgatgagaaccattgggactcatcctagctccagtactggtctaaaagatgatcttcttgaaaatttgcaggcctatcagaaacgaatgggggtgcagatgcaacgattcaagtgatcctctcgttattgcagcaaatatcattgggatcttgcacttgatattgtggattcttgatcgtctttttttcaaatgcatttatcgtcgctttaaatacggtttgaaaagagggccttctacggaaggagtgccagag

SEQ ID NO: 7 - DNA, 684 bp, Influenza B virus
ttacatccggatgctttcctataatgcacgacagaacaaaaatcagacagctacccaatcttctcagaggatatgaaaaaatcagattatcaacccaaaacgttatcaacgcagaaaaggcaccaggaggaccctacagacttggaacctcaggatcttgccctaacgctaccagtagaagcggatttttcgcaacaatggcttgggctgtcccaaaggacaacaacaaaacagcaacgaatccactaacagtagaagtaccacacatctgtacaaaagaagaagaccaaattactgtttgggggttccattctgataacaaaacccaaatgaaaaacctctatggagactcaaatcctcaaaagttcacctcatctgctaatggagtaaccacacattatgtttctcagattggcggcttcccggatcaaacagaagacggagggctaccacaaagcggcagaattgttgttgattacatggtgcaaaaacctgggaaaacaggaacaattgtctatcaaagaggtattttgttgcctcaaaaggtgtggtgcgcgagtggcaggagcaaagtaataaaagggtccttgcctttaattggtgaagcagattgccttcacgaaaaatacggtggattaaacaaaagcaagccttactacacaggagaacatgcaaaagccatag

SEQ ID NO: 8 - DNA, 896 bp, Influenza B virus
atgaacaatgctaccttcaactatacaaacgttaaccctatttctcacatcagggggagtgttattatcactatatgtgtcagcttcactgtcatacttactgtattcggatatattgctaaaattttcaccaacagaaataactgcaccaaaagtgccattggattgtgcaaacgcatcaaatgttcaggctgtgaaccgttctgcaacaaaagggatgacacttcttctctcagaaccggagtggacataccctcgtttatcttgccagggctcaacctttcagaaagcactcctaattagccctcatagattcggagaaaccagaggaaactcagctcccttgataataagggaaccttttattgcttgtggaccaaaggaatgcaaacactttgctctaacccattatgcagctcaaccagggggatactacaatggaacaagagaggacagaaacaagctgaggcatctgatttcagtcaaattgggcaaaatcccaacagtagaaaactccattttccacatggcagcttggagcgggtccgcatgccatgatggtagagaatggacatatatcggacttgatggccctgacagtaatgcattgatcaaaataaaatatggagaagcatatactgacacataccattcctatgcaaacaacatcctaagaacacaagaaagtgcctgcaattgcatcgggggagattgttatcttatgataactgatggctcagcttcaggaattagtaaatgcagatttcttaagattcgagagggtcgaataataaaagaaatatttcccacaggaagagtagaacatactgaagaatgcacatgcggatttgccagcaataaaaccatagaatgtgcctgtagagataacagttaca

SEQ ID NO: 9 - DNA, 362 bp, Influenza B virus
atgtcgctgtttggagacacaattgcctacctgctttcattgacagaagatggagaaggcaaagcagaactagcagaaaaattacactgttggttcggtgggaaagaatttgacctagactctgccttggaatggataaaaaacaaaagatgcttaactgatatacagaaagcactaattggtgcctctatctgctttttaaaacccaaagaccaagaaagaaaaagaagattcatcacagagcccctatcaggaatggggacaacagcaacaaaaaagaaaggcctgattctagctgagagaaaaatgagaagatgtgtgagttttcatgaagcatttgaaatagcagaaggccatgaaag

SEQ ID NO: 10 - DNA, 2504 bp, Human adenovirus type 4 strain
gtggcgcctacccacgatgtgaccaccgaccgcagccagcggctgacgctgcgcttcgtgcccgtggaccgggaggacaacacctactcgtacaaagtgcgctacacgctggccgtgggcgacaaccgtgtgctggacatggccagcacctattttgacatccgcggcgtgctggaccggggccctagctttaaaccctactccggcactgcctacaacagtctggctcccaagggagcgcccaatacctgccagtggaaggatgctaacagcaaaatgcatacctttggggtagctgccatgccaggtgttactgggaaaaagatagaagctgatgggctgcctattagaatagattcaacttctggaactgacacagtaatttatgctgataaaactttccaaccagaaccacaagttggaaatgacagttgggttgacaccaatgatgcagaggaaaaatatggaggcagagctctaaaggacactacaaatatgaaaccctgctatggttcattcgccaagcctaccaacaaagaaggtgggcaggctaacttaaaagattcagaaaccgccgccaccactcctaactatgatatagatctggctttctttgacggcaaaaatattgttgctaactacgatccagatattgtaatgtacacagaaaatgttgacttgcagactccagatactcatattgtatacaaacctggaaaagaggacaccagctctgaatccaatttgggtcagcaggccatgcctaacagacccaactacattggcttcagagacaattttatcgggctcatgtactacaacagcactggcaatatgggggtactggccggtcaggcctctcagctgaatgctgtggttgacttgcaagacagaaacactgaactgtcctaccagctcttgcttgactctttaggcgacagaacccggtatttcagtatgtggaatcaggcggtggacagctatgatcctgatgtgcgcattattgaaaaccatggtgtggaggatgaattgccaaactattgctttccgttaaatggtgtgggattgacagacacttaccagggtgttaaagttaaaacagatgcaggttctgaaaagtgggacaaagatgacaccacagttagtactgctaatgaaatccatgtaggcaatccttttgccatggaaatcaacatccaagccaacctgtggaggaacttcctctatgccaatgttgccctctatttgcctgataaatacaaatacacaccggccaacatcaccctgcccaccaacaccaacacctacgagtacatgaatggccgggtggtggcgccatcgctggtggacgcctacattaacatcggagcacgctggtcgctggaccccatggacaacgtctaccccttcaaccaccaccgtaacgcgggcttgcgctaccgctccatgctcctgggcaacgggcgctacgtgccattccacatccaggtgccccagaaattctttgccatcaagaaccttttgctcctgcccgggtcctatacctacgagtggaacttccgcaaggacgtcaacatgatcttgcagagttcccttggcaacgacctgcgcacagacggggcctccatcaccttcaccagcatcaacctctacgctaccttcttccccatggcgcacaacaccgcctccacgcttgaggccatgctgcgcaacgacaccaatgaccaatcctttaacgactacctctcggcggcaaacatgctatatcccatcccggccaatgccaccaacgtgcccatctccatcccctcccgcgactgggccgcctttcgcggctggtccttacgcgctctcaagaccaaagagacgccctcgctgggctccgggtttgacccctactttgtctactcgggctccatcccctacctcgacggcaccttttacctcaaccacaccttcaagaaggtttcaatcaccttcgactcttccgtcagctggcccggcaacgaccggctcctgacgcccaacgagtttgaaattaagcgcaccgtggacggcgaggggtacaacgtggcccagtgcaacatgaccaaggactggttcttggtccagatgttggcccattacaacattggctaccagggcttctacgtgcccgagggctacaaggaccgtatgtactctttcttccgcaacttccagcccatgagccgccaggtggtggacgaggttaactacaaggactaccaggccgtcaccctgccttatcagcacaacaactcgggctttgtcggttacctcgcgcccactatgcgccggggccagccctaccccgccaactacccctacccgctcattggcaaaagcgccgtcaccagcgtcacccagaaaaagttcatctgcgacagggtcatgtggcgcattcccttctccagcaacttcatgtccatgggcgcgctcaccgaccttggccagaacatgctctatgctaactccgcccacgc

SEQ ID NO: 11 - DNA, 1258 bp, Human adenovirus type 4 strain
cgaccccgtgtatccctacgatgcagacaacgaccgaccgtgcccttcatcaaccctcccttcgttctcttcagatggattccaagaaaagcccctgggggtgttgtccttaggccctggccgaccctgtcacaccaagaatggggaaattaccctcaagctgggggagggggtggaccttgacgactcgggaaaactcattgcaaacacagtaaacaaggccattgcccctctcagttttttccaacaacaccatttccccttaacatggatacccctttatacaccaaagatggaaaactatccttacaagtttctgccaccattaagtatattaaaatcaacaattttgaatacattagtctcagcttttggctcaggtttaggactcagtggcagcgccctggcagtacagttagcctctccacttacatttgatgataaagggaatataaagattaccctaaacaggggattgcatgttacaacaggagatgcaattgaaagcaacatcagttgggctaaaggtataaaatttgaagatggtgccatagctacaaacattggtaaggggtcgagattcggaaccagtagtacagaaacaggagttaataatgcttatccaatccaagttaaacttggctctggtctcagctttgacagcacaggagccataatggctggcaataaagactatgataaattaactttgtggacaacgcctgacccatcaccaaactgtcaaatacttgcagaaaatgatgcaaaactaacactttgcttaacaatgtgtgacagtcaaatactggccactgtatcagttttggttgttagaagtggaaacttaaacccaattactggcacagtaagcagtgctcaagtttttctacgttttgatgcaaatggtgttcttttaacagaacactctacatcaaaaaaatactggggctacaagcaaggagatagcatagatggcactccatacaccaatgctgttggttttatgccaaattcaacagcttatccaaagacccaaagttctactactaaaaataatatagtgggtcaagtatacatgaatggagatgtttcaaaacccatgcttcttactataactcttaatggtactgatgacaccaccagtgcatactcaatgtcattttcatacacctggactaacggaagctatatcggagcaacatttggagctaactcatacaccttctcctacatagcccaacaataatcccaccctgca

SEQ ID NO: 12 - DNA, 1326 bp, Human adenovirus type 4 strain
gcggggcaggtgacgttttgatgacgcgactatgaggaggagttagtttgcaagttctggtggggaaaagtgacgtcaaacgaggtgtggtttaaacacggaaatactcaattttcccacgctgtctaacaggaaatgaggtgtttttgggcggatgcaagtgaaaacggaccattttcgcgcgaaaactgaatgaggaagtgaaatctgagtaatttagtgtttatgacagggaggagtatttgccgagggccgagtagactttgaccgtttacgtgggggtttcgattaccgtgtttttcacctaaagttccgcgtacggtgtcaaagtccggtgtttttacgtaggtgtcagctgatcgtcagggtatttaaacctgcgctctgcagtcaagaggccactcttgagtgccagcgagaagagttttctcctccgcgccgcggtcagatctacactttgaaatatgaggcacctaagagacctgcccgatgaggaaattatcatcgcttccgggagcgagattctggaactggtggtaaatgctacgatgggcgacgaccatccggaaccccccaccccatttggaacaccttcgctgcacgatttgtatgatctggaggtggatgtgcccgaggacgaccccaacgagaaggcggtaaatgatttatttagcgatgccgcgctgctagctgccgaggaggcttcaagccctagctcagacagcgactcttcactgcacacccctagacacgacagaggtgagaaagagatccccgggcttaaatgggaaaagatggacttgcgttgctatgaggaatgcctgcccccaagcgatgatgaggacgagcaggcgattcagaacgcagcgagccatggagtgcaagccgtcagcgagagctttgcactggactgcccgcctttgcccggacacggctgtaagtcttgtgaatttcatcgcatcaatactggagataaagctgtgttatgtgcactttgctatatgagagcgtacaaccattgtgtttacagtaagtgtgattaagtgaactttaaagggaggcaaagagtagggtgactgggtgatgactggtttatttatgtatatctgttttttatataggtcccgtttctgacgcagatgatgagacccccactacagagtccactttgtcaccccctgaaattggcacgtctccatctgacaatattgttagaccagttcctgtaagagccactgggaggagagcagctgtagaatgtttggatgatttgcttcagggtggagatgaacctttggacttgtgtacccggaaacgccccaggca

SEQ ID NO: 13 - DNA, 2654 bp, Human adenovirus type 5 strain
gtggcgcctacgcacgacgtgaccacagaccgggacatcccagcgtttgacgctgcggttcatccctgtggaccgtgaggatactgcgtactcgtacaaggcgcggttcaccctagctgtgggtgataaccgtgtgctggacatggcttccacgtcctttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaacagaaattaatcatgcagctgggagagtcctaaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcagccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaagcaggcggtggacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggctagtggactgctacattaaccttggagcacgctggtcccttgactatatggacaacgtcaaccccttcaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcacc

SEQ ID NO: 14 - DNA, 2012 bp, Human adenovirus type 5 strain
ttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcagaaaatttcaagtcatttttcattcagtagtatagccccaccaccacatagcttatacagatcacc

SEQ ID NO: 15 - DNA, 616 bp, Human adenovirus type 5 strain
agccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaa

SEQ ID NO: 16 - DNA, 2245 bp, Human adenovirus type 7 strain
gtggcgcccacccacgatgtgaccaccgaccgtagccagcgactgatgctgcgcttcgtacccgttgaccgggaagacaatacctactcttacaaagttcgctacacgctggctgtaggcgacaacagagtgcttgacatggccagcacattctttgacattcggggggtgcttgatagaggtcctagctttaagccatattctggcacagcttacaattcactggctcctaagggcgcgcccaatacatctcagtggatagttacagcaggagaagaaagagcagtaactaccaccacaaacacatttggcattgcttccatgaagggagacaatattactaaagaaggtttagaaattgggaaagacattactgcagacaacaagcccatttatgccgataaaacatatcagccagagcctcaagttggagaagaatcatggactgatactgatggaacaaatgaaaagtttggaggtagagctcttaaaccagctaccaaaatgaagccatgctacgggtcttttgcaagacctacaaatataaaagggggccaagctaaaaacagaaaagtaaaaccaaccgaaggagatgttgagactgaggagccagatattgatatggaattttttgatggtagagaagctgctgacgctttttcgcctgaaattgtgctttacacggaaaatgtcaatttagaaactccagacaggccatgtagtttacaagccaggaacttctgatgataactctcatgcatatttgggtcaacaagccatgcctaacagacccaattacattggcttcagggataactttgtaggcctaatgtactacaacagtactggaaatatgggagttttggctggccaagcatcacaactgaatgcagtggttgacttgcaggacagaaacactgaactgtcatatcagcttttgcttgattctctgggagacagaaccagatacttcagtatgtggaaccaggctgtggacagttatgatcccgatgttcgcattattgaaaatcacggcatcgaggatgaactgcctaattactgttttcctctggatggcataggaccagcgaaaacatatcaaggcattaaatctaaagacaatggatgggaaaaagatgataatgtttctaaatctaatgaaatagccataggcaacaaccaggctatggaaattaatatccaagctaacctttggagaagttttctgtactccaatgtggctttgtaccttccagatgtttacaagtacacgccaactaacattactctgcccgccaacaccaacacctatgagtacatgaacgggcgagtggtatccccatctctggttgattcatacatcaacattggcgccaggtggtctcttgacccaatggacaatgtgaatccattcaaccaccaccgcaatgctggtctgcgctaccggtccatgcttctgggcaatggtcgttatgtgcctttccacatacaagtgcctcaaacattactttgctgtcaagaacctacttgttctacctggctcctacacctatgagtggaacttcagaaaggatgtgaacatggtcctgcaaagttcccttggaaatgacctcagaacagatggtgctaccataagtttcaccagcatcaatctgtatgccaccttcttccccatggctcacaacacagcttccacccttgaagccatgctgcgcaacgataccaatgatcagtcattcaacgactacctctctgcagctaacatgctttaccccatccctgccaatgcaaccaacattccaatttccatcccatctcgcaactgggcagccttcaggggctggtccttcactaggctcaaaaccaaggagactccatctcttggatcagggttcgatccctacttcgtatattctggatctattccctacctggatggcaccttttaccttaaccacactttcaagaaggtctccatcatgtttgactcctcagtcagctggcctggcaatgacaggctgttgagcccaaatgagtttgaaatcaagcgcactgtggacggggaagggtacaatgtggcccaatgtaacatgaccaaagactggttcctggttcagatgcttgccaactacaacattggctaccagggcttttacatccctgagggatacaaggatcgcatgtactcctttttcagaaacttccagcctatgagcaggcaggtggttgatgaggttaattacac

SEQ ID NO: 17 - DNA, 712 bp, Human adenovirus type 7 strain
ccttcaaccctgtctacccctatgaagatgaaagcacctcccaacacccctttataaacccagggtttatttccccaaatggctttacacaaagcccagacggagttcttactttaaaatgtttaaccccactaacaaccacaggcgggtctctacagttaaaagtgggagggggtcttacaatagatgacaccgacggttttttgaaagaaaacataagtgccgccacaccactcgttaagactggtcactctataggtttgtcgctaggacccggattaggaacaaatgaaaactaactttgtgccaaattgggagaaggacttacattcaattccaacaacatttgcattgatgacaatattaacaccctatggacaggagttaaccccaccacagccaactgtcaaataatggcctccagtgaatctaatgattgcaaattaattctaacactagttaaaactggagcccttgtcactgcatttgtttatgttataggagtatctaacgattttaatatgctaactacacataaaaatataaatttcactgcagagctgttttttgattctactggtaatttactaactagcctttcatccctaaaaactccacttaatcataaatcagggcaaaacatggctactggtgcccttactaatgctaaaggtttcatgcccagcacaactgcctatcctttcaatgttaa

SEQ ID NO: 18 - DNA, 615 bp, Human adenovirus type 7 strain
aagagttttctcctccgcgccgcaagtcagttctgcgctttgaaaatgagacacctgcgcttcctgccacaggagattatctccagtgagaccgggatcgaaatactggagtttgtggtaaataccctaatgggagacgacccggaaccgccagtgcagccttttgatccacctacgctgcacgatctgtatgatttagaggtagacgggccggaggatcccaatgagggagctgtgaatgggttttttactgattctatgctgctagctgccgatgaaggattggacataaaccctcctcctgagacccttgtcaccccaggggtggttgtggaaagcggcagaggtgggaaaaaattgcctgatctgggagcagctgaaatggacttgcgttgttatgaagagggttttcctccgagtgatgatgaagatggggaaactgagcagtccatccataccgcagtgaatgagggagtaaaagctgccagcgatgtttttaagttggactgtccggagctgcctggacatggctgtaagtcttgtgaatttcacaggaataacactgggatgaaagaactattgtgtgcgctttgctatatgagaatgcactgccac

SEQ ID NO: 19 - DNA, 204 bp, Human parainfluenza virus 1
tagacccacacgatttctggagatgtcccgtaggagaacctctactgagcgacaaccccaatatctcattattacccggaccaagtctactttctggatcaaccacaatctcaggatgtgttaggctaccttcattatcaattggtgatgcaatatatgcatattcatcaaacttaatcactcaaggatgtgcagatataggga

SEQ ID NO: 20 - DNA, 213 bp, Human parainfluenza virus 3
caaatctaattactcgaggttgtcaggatataggaaaatcatatcaagtcttacagatagggataataactgtaaactcagacttggtacctgacttaaatcctaggatctctcatactttcaacataaatgacaataggaagtcatgctctctagcactcctaaatacagatgtatatcaactgtgttcaactcccaaagttgatgaaagat

SEQ ID NO: 21 - DNA, 230 bp, Human parainfluenza virus 3
acttaggacaaaagaggtcaataccaacaactattagcagtcacactcgcaagaataagagagaagggaccaaaaaagtcaaataggagaaatcaaaacaaaaggtacagaacaccagaacaacaaaatcaaaacatccaactcactcaaaacaaaaattccaaaagagaccggcaacacaacaagcactgaacacaatgccaacttcaatactgctaattattacaacc

SEQ ID NO: 22 - DNA, 412 bp, Human rhinovirus 89
gtcaaaggtcaagcacttctgtttccccggtcaatgaggatatgctttacccaaggcaaaaaccttagagatcgttatccccacactgcctacacagagcccagtaccatttttgatataattgggttggtcgctccctgcaaacccagcagtagacctggcagatgaggctggacattccccactggcgacagtggtccagcctgcgtggctgcctgctcacccttcttgggtgagaagcctaattattgacaaggtgtgaagagccgcgtgtgctcagtgtgcttcctccggcccctgaatgtggctaaccttaaccctgcagccgttgcccataatccaatgggtttgcggtcgtaatgcgtaagtgcgggatgggaccaactactttgggtgtccgtgtttcctgttt

SEQ ID NO: 23 - DNA, 379 bp, Human respiratory syncytial virus type A and B
aagtgctctatcatcacagatctcagcaaattcaatcaagcatttcgatatgaaacgtcatgtatttgtagtgatgtgctggatgaactgcatggtgtacaatctctattttcctggttacatttaactattcctcatgtcacaataatatgcacatataggcatgcacccccctatataagagatcataatgtagatcttaacaatgtagatgaacaaagtggattatatagatatcacatgggtggtattgaagggtggtgtcaaaaactatggaccatagaagctatatcactattggatctaatatctctcaaagggaaattctcaattactgctttaattaatggtgacaatcaatcaatagatataagcaaac

SEQ ID NO: 24 - DNA, 106 bp, Human respiratory syncytial virus type A
aatacaaagatggctcttagcaaagtcaagttgaatgatacactcaacaaagatcaacttctgtcatccagcaaatacaccatccaacggagcacaggagatagta

SEQ ID NO: 25 - DNA, 128 bp, Human respiratory syncytial virus type B
ggcaaatacaaagatggctcttagcaaagtcaagttaaatgatacattaaataaggatcagctgctgtcatccagcaaatacactattcaacgtagtacaggagataatattgacactcccaattatg

SEQ ID NO: 26 - DNA, 432 bp, West Nile virus strain NY99-flamingo382-99
ggccaatacgatttgtgttggctctcttggcgttcttcaggttcacagcaattgctccgacccgagcagtgctggatcgatggagaggtgtgaacaaacaaacagcgatgaaacaccttctgagttttaagaaggaactagggaccttgaccagtgctatcaatcggcggagctcaaaacaaaagaaaagaggaggaaagaccggaattgcagtcatgattggcctgatcgccagcgtaggagcagttaccctctctaacttccaagggaaggtgatgatgacggtaaatgctactgacgtcacagatgtcatcacgattccaacagctgctggaaagaacctatgcattgtcagagcaatggatgtgggatacatgtgcgatgatactatcacttatgaatgcccagtgctgtcggctggtaatgatccag

SEQ ID NO: 27 - DNA, 94 bp, West Nile virus strain NY99-flamingo382-99
atttggctaccgtcagcgatctctccaccaaagctgcgtgcccgaccatgggagaagctcacaatgacaaacgtgctgacccagcttttgtgtg

SEQ ID NO: 28 - DNA, 153 bp, West Nile virus strain NY99-flamingo382-99
gaagcttgaaagggcagttctgggtgaagtcaaatcatgtacgtggcctgagacgcataccttgtggggcgatggaatccttgagagtgacttgataataccagtcacactggcgggaccacgaagcaatcacaatcggagacctgggtacaa

SEQ ID NO: 29 - DNA, 598 bp, Human coronavirus 229E
tagaacagtttatggccccattaaaaatgtgtaccacatttaccaatcatatatgcacatagaccctttccctaaacgagttattgatttctaaactaaacgacaatgtcaaatgacaattgtacgggtgacattgtcacccatttgaagaattggaattttggttggaatgttattctaaccatattcattgttattcttcagtttggacactataaatactccagattgttttatggtttgaagatgcttgtactgtggcttctttggccactcgtacttgctttgtcaatctttgacacctgggctaattgggattctaattgggcctttgttgcatttagcttttttatggccgtatcaacactcgttatgtgggtgatgtacttcgcaaacagtttcagacttttccgacgtgctcgaactttttgggcatggaatcctgaggttaatgcaatcactgtcacaaccgtgttgggacagacatactatcaacccattcaacaagctccaacaggcattactgtgaccttgctgagcggcgtgctttacgttgacggacatagattggcttcaggtgttcaggttcataacctac

SEQ ID NO: 30 - DNA, 358 bp, Human coronavirus OC43
tgattattttgtggcttatgtggccccttactataatcttaactattttcaattgcgtatacgcattgaataatgtgtatcttggcctttctatagtttttaccatagtggccattattatgtggattgtgtattttgtgaatagtatcaggttgtttattagaactggaagtttttggagtttcaacccagaaacaaacaacttgatgtgtatagatatgaaaggaacaatgtatgttaggccgataattgaggactatcatactctgacggtcacaataatacgcggccatctttacattcaaggtataaaactaggtactggctattcttgggcagatttgccagcttatatgac

SEQ ID NO: 31 - DNA, 125 bp, Streptococcus pneumoniae
tatcgaactcttacgcaatctagcagatgaagcaggtttgccgaaaacgcttgatacagggagtttagctggaattaaaacgcacgagtattgcacgaataaccaaccaaacaaccactcagacc

SEQ ID NO: 32 - DNA, 99 bp, Streptococcus pneumoniae
ggtttggcaagtagcgatagctttctccaagtggaagaccccagcaattcaagtgttcgcggagcggtaaacgatttgttggctaagtggcatcaagat

SEQ ID NO: 33 - DNA, 281 bp, Streptococcus Pyogenes
aatcttttgtaggtcaacatgcagctacaggatgtgttgctactgcaactgctcaaattatgaaatatcataattaccctaacaaagggttgaaagactacacttacacactaagctcaaataacccatatttcaaccatcctaagaacttgtttgcagctatctctactagacaatacaactggaacaacatcttacctacttatagcggaagagaatctaacgttcaaaaaatggcgatttcagaattgatggctgatgttggtatttcagtagacatg

SEQ ID NO: 34 - DNA, 370 bp, Streptococcus Pyogenes
ggcagggcaagcagtatcattaatcactagtgccatcttgcaaatggcgattattttttaccttacagaaaaaactggatccgcgatggtcttgtctatggcttcactattaggttttttaccctatgcggtctttggacctgcaattggtgtgctagtggatcgtcatgataggaagaagataatgattggtgctgatttaattatcgcagcagctggttcggtgcttactattgttgcattctatatggagctacctgtctggatggttatgatagtattgtttatccgtagcattggaacagcttttcacaccccggctctcaatgcggttacgccacttttagtaccagaagaacagcttacgaaa

SEQ ID NO: 35 - DNA, 248 bp, Streptococcus Pyogenes
aactgatttttagtaaacagttgacgatattctcgattgacccattttgaaacaaagtacgtatatagcttccaatatttatctggaacatctgtggtatggcgggtaagttttattaagacactgtttacttttggtttaggatgaaagcattccgctggcagcttaagcaattgctgaatcgagacttgagtgtgcaagagcaaccctagtgttcggtgaatatccaaggtacgcttgtagaatcc

SEQ ID NO: 36 - DNA, 176 bp, Streptococcus Pyogenes
caacgggtgaatgctatagagattgatgaaggtttatgtcatgccacgaaaaaagcagttgaaccttttcagaatataaaagttattcatgaggatattttgaagtttagctttcctaaaaatacagactataaaatatttggtaatattccctacaatattagtactgatattgt

SEQ ID NO: 37 - DNA, 369 bp, Mycoplasma pneumoniae
agggggttcttcaggctcaggtcaatctggcgtggatctctcccccgttgaaaaagtgagtgggtggcttgtggggcagttaccaagcacgagtgacggaaacacctcctccaccaacaacctcgcgcctaatactaatacggggaatgatgtggtgggggttggtcgactttctgaaagcaacgccgcaaagatgaatgacgatgttgatggtattgtacgcaccccactcgctgaactgttagatggggaaggacaaacagctgacactggtccacaaagcgtgaagttcaagtctcctgaccaaattgacttcaaccgcttgtttacccacccagtcaccgatctgtttgatccggtaactatgtt

SEQ ID NO: 38 - DNA, 135 bp, Neisseria meningitides
ttggatgcggtggctgcggtaggtggttcaacggcaaatgtgcaggatacgaatgtgcagctgacacgtggcaatgtagtacgaactgttgccttggaagatttagttgcaaatccgcgacaaaatattttgctg

SEQ ID NO: 39 - DNA, 254 bp, Neisseria meningitides
ggtgctgcatctgctggcgccgctggcaacaaaattcaacgaacgctatccgcatatccgactttcgctcgtttcttccgaaggctatatcaatctgattgaacgcaaagtcgatattgccttacgggccggagaattggacgattccgggctgcgtgcacgccatctgtttgacagccgcttccgcgtaatcgccagtcctgaatacctggcaaaacacggcacgccgcaatctgcagaagagcttgccggtc

SEQ ID NO: 40 - DNA, 305 bp, Bordetella pertussis
gaagtagcagcgcagccctccaacgcgccatccccgtccggccggcaccatcccgcatacgtgttggcaaccgccaacgcgcatgcgtgcagattcgtcgtacaaaaccctcgattcttccgtacatcccgctactgcaatccaacacggcatgaacgctccttcggcgcaaagtcgcgcgatggtaccggtcaccgtccggaccgtgctgacccccctgccatggtgtgatccgtaaaataggcaccatcaaaacgcagaggggaagacgggatgcgttgcactcgggcaattcgccaaaccgc

SEQ ID NO: 41 - DNA, 222 bp, Bordetella pertussis
cggcgcattccgcccgaaaacatccgcagggtaacgcgggtctatcacaacggcatcaccggcgagaccacgaccacggagtattccaacgctcgctacgtcagccagcagactcgcgccaatcccaacccctacacatcgcgaaggtccgtagcgtcgatcgtcggcacattggtgcgcatggcgccggtgataggcgcttgcatggcgcggcaggccgaa

SEQ ID NO: 42 - DNA, 150 bp, Chlamydia pneumoniae
atgctgataacatccgcattgctcagccaaaactacctacagctgttttaaacttaactgcatggaacccttctttactaggaaatgccacagcattgtctactactgattcgttctcagacttcatgcaaattgtttcctgtcagatca

SEQ ID NO: 43 - DNA, 133 bp, Chlamydia pneumoniae
agcgttcaatctcgttggtttattcggagttaaaggtactactgtaaatgcaaatgaactaccaaacgtttctttaagtaacggagttgttgaactttacacagacacctctttctcttggagcgtaggcgct

SEQ ID NO: 44 - DNA, 346 bp, Chlamydia pneumoniae
aaggacttctatcagattacgaaacggcattacaacggctagaaatcaattataagactgaagttgagcatattcgtgagggagatgcagatttagatcatggtgtcattcgccaaggttaaagtctacgttgcctctaagagaaaacttcaagttggagataaaatggctggacgacacggaaataaaggtgttgtttccaaaatcgttcccgaagcggatatgccatatctctctaacggagaaactgtacaaatgatccctgaaccccccctcggtgccttcaaggatgaaccttggacaggtattagaaacacacctaggttatgcagcaaaaactgcaggc

SEQ ID NO: 45 - DNA, 199 bp, Bacillus anthracis strain Ba Sterne
cgtcctggtgaaccaccaacagtagaaaatgccaagagcttacttgtgtctcgtttcttcgatccaaagcgctatgatttagcaaatgtaggtcgctacaagatcaacaagaagttacacattaaaaacagattgtttaaccaacgtttagctgaaacattagtagatccagaaactggtgaaattttagcggcagaag

SEQ ID NO: 46 - DNA, 354 bp, Bacillus anthracis
tagcggcggttaatcctagtgatccattagaaacgactaaaccggatatgacattaaaagaagcccttaaaatagcatttggatttaacgaaccgaatggaaacttacaatatcaagggaaagacataaccgaatttgattttaatttcgatcaacaaacatctcaaaatatcaagaatcagttagcggaattaaacgcaactaacatatatactgtattagataaaatcaaattaaatgcaaaaatgaatattttaataagagataaacgttttcattatgatagaaataacatagcagttggggcggatgagtcagtagttaaggaggctcatagagaagtaattaattcgt

SEQ ID NO: 47 - DNA, 246 bp, Bacillus anthracis
ttacacgttttgctgaccaatctaagcctgcgttcttcgtaaatggttttgcagcgaatgatccctcatcaacattacgtatttgggaacgtgtggatgattttggatatagtaatctagctccaattgtaattatgaattgccgccctgaccgcgttgatcgtactgagcagtttgctagggatgttttgccatatattaaagcggaaatagttattgcgattggagaaacgactgcacctatta

SEQ ID NO: 48 - DNA, 510 bp, Variola major virus
aactattacaattaaatcattgactgctaaagatgccggtacttatgtatgtgcattctttatgacatcaactacaaatgatactaataaagtagattatgaagaatactctacagagttgattgtaaacacagatagtgaatcgactatagacataatactatctggatcttcacattcaccggaaactagttctgagaaacctgattatataaataattttaattgctcgttggtatttgaaatcgcgactccgggaccaattactgataatgtagaaaatcatacagacactgtcacatacactagtgatatcattaatacagtaagtacatcatctggagaatccacaacagacaagacgtcgggaccaattactaataaagaagatcatacagtcacagacactgtctcatacactacagtaagtacatcatctgaaattgtcactactaaatcaaccgccaatgatgcgcacaatgataatgaaccatctactgtgtcaccaac

SEQ ID NO: 49 - DNA, 291 bp, Variola virus
tcgggaacatacgcttccagattatgtgatagcaagactaacacacaatgtacaccgtgtggttcgggtacctttacatctcgcaataatcatttacccgcttgtctaagttgtaacggaagatgcaatagtaatcaggtagagacgcgatcgtgtaacacgactcacaatagaatctgtgaatgctctcccggatattattgtcttcttaaaggatcatccggatgcaaggcatgtgtttcccaaacaaaatgtggaataggatacggagtatccggacacacgtctgtt

SEQ ID NO: 50 - DNA, 443 bp, Zaire Ebola virus strain Mayinga
tactaccacaatatcggaacttttctttctcattgaaagagaaagagttgaatgtaggtagaaccttcggaaaattgccttatccgactcgcaatgttcaaacactttgtgaagctctgttagctgatggtcttgctaaagcatttcctagcaatatgatggtagttacggaacgtgagcaaaaagaaagcttattgcatcaagcatcatggcaccacacaagtgatgattttggtgaacatgccacagttagagggagtagctttgtaactgatttagagaaatacaatcttgcatttagatatgagtttacagcaccttttatagaatattgcaaccgttgctatggtgttaagaatgtttttaattggatgcattatacaatcccacagtgttatatgcatgtcagtgattattataatccaccacataacctcacactg

SEQ ID NO: 51 - DNA, 351 bp, Lassa virus
gcgcaccggggatcctaggcatttttggttgcgcaattcaagtgtcctatttaaaatgggacaaatagtgacattcttccaggaagtgcctcatgtaatagaagaggtgatgaacattgttctcattgcactgtctgtactagcagtgctgaaaggtctgtacaattttgcaacgtgtggccttgttggtttggtcactttcctcctgttgtgtggtaggtcttgcacaaccagtctttataaaggggtttatgagcttcagactctggaactaaacatggagacactcaatatgaccatgcctctctcctgcacaaagaacaacagtcatcattatataatggtgggcaa

SEQ ID NO: 52 - DNA, 431 bp, Francisella tularensis
atcgtaatgttagctgtatcatcatttaataaactgctgtttattttattttaattaatgttataatcgatttgagtatatgtgaatatttaaaaataggagtatctatatgaaaaaaataattaagcttagtcttttatctttatcaatcgcaggtttagcgagctgttctactctagggttaggtggctctgatgatgcaaaagcttcagctaaagatactgctgctgctcagacagctactactgagcaagctgctgctgtatctaagccaactgcaaaagtaagtttaaataaacttggtcaggataaaataaaagcaactgtatatacagcatacaataataacccacaaggaagtgtaagattacaatggcaggctccagaaggttctaagtgccatgatacaagcttcccaattactaagtatg

SEQ ID NO: 53 - DNA, 111 bp, Francisella tularensis
cagatatatccaaacaatggcacctagtaatatttctggtgctaatggcagagcgggtactaacatgattggtgctggtttaacatggttctttggtggcaaagatactac

SEQ ID NO: 54 - DNA, 265 bp, Yersinia pestis strain D15 isolate
ataaaggggagtggataacgttgcagcagcttcgcgatattgacggccgggcattctctgatgcaggcctgtagaaaattacgctttaacaattaccgccaacggtaacaaactgagttatccaaaatctgagcctcgccatcgtgcggggttttttaatgggccaggcccagcaataaatcccaaggggacagcatgctattccgaaatatcgcacgtaaatattatgccgaggcaggtgaaggtggcgaaggtggaggcgggg

SEQ ID NO: 55 - DNA, 525 bp, Y.pestis
tatgaaaaaaatcagttccgttatcgccattgcattatttggaactattgcaactgctaatgcggcagatttaactgcaagcaccactgcaacggcaactcttgttgaaccagcccgcatcactcttacatataaggaaggcgctccaattacaattatggacaatggaaacatcgatacagaattacttgttggtacgcttactcttggcggctataaaacaggaaccactagcacatctgttaactttacagatgccgcgggtgatcccatgtacttaacatttacttctcaggatggaaataaccaccaattcactacaaaagtgattggcaaggattctagagattttgatatctctcctaaggtaaacggtgagaaccttgtgggggatgacgtcgtcttggctacgggcagccaggatttctttgttcgctcaattggttccaaaggcggtaaacttgcagcaggtaaatacactgatgctgtaaccgtaaccgtatctaaccaataatccatatagat

SEQ ID NO: 56 - DNA, 523 bp, Arabidopsis thaliana
acatcgaccaggtcaaatcctcgttgacagaccgtattgacatatcaggtcagaactcttgggttgggaaaggtggagccttcactggtgaaatcagcgtggaacagctcaaagaccttggctgcaagtgggtcattcttgggcattccgaacggagacatgtcatcggagaaaaagatgagtttatcgggaagaaagctgcatatgcattgagtgagggtcttggagtgatagcttgtattggggaaaagctagaagagagggaagcaggcaagacgtttgatgtttgcttcgcgcaactgaaggcgtttgctgatgctgtgcctagctgggacaatatagttgttgcatacgagcctgtatgggcaattggaactggtaaagttgcatctcctcagcaagcacaagaagtccatgtagctgtccgcggttggctaaagaagaatgtctctgaggaagttgcttccaaaacgagaatcatatatggaggttctgtcaatggaggcaacagtgcagagcttgc

SEQ ID NO: 57 - DNA, 543 bp, Arabidopsis thaliana NAC1
tatatgtagagacaacatgggaagctgttttgatgagacagcctctgcatcgcttcctccactgatggatccttacatcaactttgaccaagaaccctcttcttatctcagtgatgatcatcactacatcatcaatgagcacgtaccctgcttctccaatttgtcacagaaccaaaccttaaactcgaacctaaccaactcagtctctgaactcaagattccatgcaagaaccctaaccccttgtttactggtggttcagcctcagccacgctcacaggcctcgactcattctgttcttcagatcagatggttctcagagctctactcagtcagctcactaagattgatggaagcctcgggcctaaagaatcacagagttatggagaaggtagctcggagagcctcctgaccgacatcggtattccaagcactgtttggaattgctgatgatcgagtgtaacgagagttactattgctatattcctatccatgattggaacaattcttcggggggaaataacgtgtgcttgtctgattgtaca

SEQ ID NO: 58 - DNA, 2233 bp, Human adenovirus type 7 vaccine
gtggcgcccacccacgatgtgaccaccgaccgtagccagcgactgatgctgcgcttcgtgcccgttgaccgggaggacaatacatactcttacaaagtgcggtacaccctcgccgtgggcgacaacagagtgcttgacatggccagcacattctttgacattaggggggtgcttgatagaggtcctagcttcaagccatattccggcacagcttacaattcactggctcctaagggcgcgcctaacacatctcagtggatagttacaacgggagaagacaatgccaccacatacacatttggcattgcttccacgaagggagacaatattactaaggaaggtttagaaattgggaaagacattactgcagacaacaagcccatttatgccgataaaacatatcagccagagcctcaagttggagaagaatcatggactgatattgatggaacaaatgaaaatttggaggtagagctcttaaaccagctactaaaatgaagcccatgctacgggtcttttgcaagacctacaaacataaaagggggccaagctaaaacagaaaagtaacaccaaccgaaggagatgttgaagctgaggagccagatattgatatggaatttttcgatggtagagaagctgctgacgctttttcgcctgaaattgtgctttacacggaaaatgtcaatttggaaactccagacagccatgtggtatacaagccaggaacttctgatggtaactctcatgcaaatttgggtcaacaagccatgcctaacagacccaattacattggcttcagggataactttgtaggtcttatgtactacaacagtactggaaatatgggagttttggccggccaagcatcacaactgaatgcagtggttgacttgcaggacagaaacactgaactgtcatatcagcttttgcttgattctctgggagacagaagcagatacttcagcatgtggaatcaggctgtggacagctatgatcccgatgttcgtattattgaaaatcatggcgtcgaggatgaactgcctaattactgttttcctctggatggcataggaccagggaacaaatatcaaggcattaaacctagagacactgcatgggaaaaagatactaaagtttctacagctaatgaaatagccataggcaacaatctggctatggaaattaatatccaagctaatctttggagaagttttctgtactccaatgtggctttgtaccttccagatgtttacaagtacacgccaactaacattactctgcccgctaacaccaacacctatgagtacatgaacgggcgagtggtttccccatctctggtcgattcatacatcaacattggcgccaggtggtctcttgacccaatggacaatgtgaatccatttaaccaccaccgcaatgctggcctacgctaccggtccatgcttctgggcaatggccgttatgtgcctttccacatacaagtgcctcaaaaattctttgctgtcaagaacctacttcttctacctggctcctacacctatgagtggaacttcagaaaggatgtgaacatggtcctgcaaagttcccttggaaatgacctcagaacagatggtgctaacataagtttcaccagcatcaacctctatgccaccttcttccccatggctcacaacaccgcttcaactcttgaagccatgctgcgcaacgataccaatgatcagtcattcaacgactacctctctgcagctaacatgctttaccccatccctgccaatgcaaccaacattccaatttccatcccatctcgcaactgggcagccttcaggggctggtccttcaccagactcaaaaccaaggagactccatctcttggatcagggttcgatccctacttcgtttattctggatctattccctacctggatggcactttttaccttaaccacactttcaagaaggtctccatcatgtttgactcctcagtcagctggcctggcaatgacaggctgttgtctccaaatgagtttgaaatcaagcgcactgtggatggggaaggatacaatgtggcccaatgcaacatgaccaaagactggttcctggttcagatgcttgccaactacaacattggctaccagggcttttacatccctgagggatacaaggatcgcatgtactcctttttcagaaacttccagcctatgagcaggcaggtggttgatgaggttaattacac

SEQ ID NO: 59 - DNA, 523 bp, Arabidopsis thaliana; identical to SEQ ID NO: 56

SEQ ID NO: 60 - DNA, 879 bp, Adenovirus 3
tgagacacctgcgcttcctgccacaggaggttatctccagtgagaccgggatcgaaatactggagtttgtggtaaataccctaatgggagacgacccggaaccgccagtgcagcctttcgatccacctacgctgcacgatctgtatgatttagagatagacgggccggaggatcccaatgaggaagctgtgaatgggttttttactgattctatgctgctagctgctgatgaaggattggacataaaccctcctcctgagacacttgttaccccaggggtggttgtggaaagcggcataggtgggaaaaaattgcctgatctgggagcagctgaaatggacttgcgttgttatgaagagggttttcctcccagtgatgatgaagatggggaaactgagcagtccatccataccgcagtaaatgagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccactttatttacagtaagtgtatttaagtgaaatttaaaggaatagtgtagctatttaataactgttgaatggtagatttatgtttttttcttgcgattttttgtaggtcctgtgtctgatgatgagtcaccttctcctgattcaactacctcacctcctgaaattcaggcgcccgcacctgcaaacgtatgcaagcccattcctgtgaagcctaagcctgggaaacgccctgctgtggataagcttgaggacttgttggagggtggggatggacctttggaccttagtacccggaaactgccaaggcaatga

SEQ ID NO: 61 - DNA, 595 bp, Adenovirus 3
ccagcacattctttgacattcggggggtgcttgatagaggtcctagcttcaagccatattccggcacagcttacaattcactcgctcctaagggcgcgcccaatacatctcagtggatagttacaacaaatggggacaatgcagtaactaccaccacaaacacatttggcattgcttccatgaagggagacaatattactaaagaaggtttgcaaattgggaaagacattaccactactgaaggagaagaaaagcccatttatgccgataaaacatatcagccagagcctcaagttggagaagaatcatggactgatactgatggaacaaatgaaaagtttggtggaagagcccttaaaccagctaccaacatgaagccatgctacgggtcttttgcaagacctacaaacataaaagggggccaagctaaaaacagaaaagtaaaaccaacaaccgaaggaggggttgaaactgaggaaccagatattgatatggaatttttcgatggtagagatgctgttgcaggagctttagcgcctgaaattgtgctttatacggaaaatgtaaatttggaaactccagacagtcatgtggt

SEQ ID NO: 62 - DNA, 746 bp, Adenovirus 3
aagcggctccctccaacttaaagtgggaagtggtcttacagtagacactactgatggatccttagaagaaaacatcaaagttaacacccccctaacaaagtcaaaccattctataaatttaccaataggaaacggtttgcaaatagaacaaaacaaactttgcagtaaactcggaaatggtcttacatttgactcttccaattctattgcactgaaaaataacactttatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctca

SEQ ID NO: 63 - DNA, 868 bp, Adenovirus 7
tgagacacctgcgcttcctgccacaggagattatctccagtgagaccgggatcgaaatactggagtttgtggtaaataccctaatgggagacgacccggaaccgccagtgcagccttttgatccacctacgctgcacgatctgtatgatttagaggtagacgggccggaggatcccaatgagggagctgtgaatgggttttttactgattctatgctgctagctgccgatgaaggattggacataaaccctcctcctgagacccttgtcaccccaggggtggttgtggaaagcggcagaggtgggaaaaaattgcctgatctgggagcagctgaaatggacttgcgttgttatgaagagggttttcctccgagtgatgatgaagatggggaaactgagcagtccatccataccgcagtgaatgagggagtaaaagctgccagcgatgtttttaagttggactgtccggagctgcctggacatggctgtaagtcttgtgaatttcacaggaataacactgggatgaaagaactattgtgctcgctttgctatatgagaatgcactgccactttatttacagtaagtgtatttaagtgaaatttaaaggaatagtgtagctgtttaataactgttgaatggtagatttatgtttttacttgcgattttttgtaggtcctgtgtctgatgatgagtcaccttctcctgattcaactacctcacctcctgaaattcaggcgcccgcacctgcaaacgtatgcaagcccattcctgtaaagcctaagcctgggaaacgccctgctgtggataagcttgaggacttgttggagggtggggatggacctttggaccttagtacccggaaactgcc

SEQ ID NO: 64 - DNA, 513 bp, Adenovirus 7
ccagcacattctttgacattcggggggtgcttgatagaggtcctagctttaagccatattctggcacagcttacaattcactggctcctaagggcgcgcccaatacatctcagtggatagttacagcaggagaagaaagagcagtaactaccaccacaaacacatttggcattgcttccatgaagggagacaatattactaaagaaggtttagaaattgggaaagacattactgcagacaacaagcccatttatgccgataaaacatatcagccagagcctcaagttggagaagaatcatggactgatactgatggaacaaatgaaaagtttggaggtagagctcttaaaccagctaccaaaatgaagccatgctacgggtcttttgcaagacctacaaatataaaagggggccaagctaaaaacagaaaagtaaaaccaaccgaaggagatgttgagactgaggagccagatattgatatggaattttttgatggtagagaagctgctgacg

SEQ ID NO: 65 - DNA, 977 bp, Adenovirus 7
tgaccaagagagtccggctcagtgattccttcaaccctgtctacccctatgaagatgaaagcacctcccaacacccctttataaacccagggtttatttccccaaatggctttacacaaagcccagacggagttcttactttaaaatgtttaaccccactaacaaccacaggcgggtctctacagttaaaagtgggagggggtcttacaatagatgacaccgacggttttttgaaagaaaacataagtgccgccacaccactcgttaagactggtcactctataggtttgtcgctaggacccggattaggaacaaatgaaaacaaactttgtgccaaattgggagaaggacttacattcaattccaacaacatttgcattgatgacaatattaacaccctatggacaggagttaaccccaccacagccaactgtcaaataatggcctccagtgaatctaatgattgcaaattaattctaacactagttaaaactggagcccttgtcactgcatttgtttatgttataggagtatctaacgattttaatatgctaactacacataaaaatataaatttcactgcagagctgttttttgattctactggtaatttactaactagcctttcatccctaaaaactccacttaatcataaatcagggcaaaacatggctactggtgcccttactaatgctaaaggtttcatgcccagcacaactgcctatcctttcaatgttaattccagagaaaaagaaaactacatttacggaacttgttactacacagctagtgatcacactgcttttcccattgacatatctgtcatgcttaaccaaagagcattaaataatgagacatcatattgtattcgtgtaacttggtcctggaacacaggagttgccccagaagtgcaaacctctgctactaccctagtcacctctccatttaccttttactacattagagaagacgactga

SEQ ID NO: 66 - DNA, 879 bp, Adenovirus 7 FS Navy
atgagacacctgcgtttcctgccacaggagattatctccagtgagaccgggatcgaaatactggagtttgtggtaaataccctaatgggagacgacccggaaccgccagtgcagcctttcgatccacctacgctgcacgatctgtatgatttagaggtagacgggcctgaggatcccaatgaggaagctgtgaatgggttttttactgattctatgctgctagctgccgatgaaggattggacataaaccctcctcctgagacccttgttaccccaggggtggttgtggaaagcggcagaggtgggaaaaaattgcctgatctgggagcagctgaaatggacttgcgttgttatgaagagggttttcctccgagtgatgatgaagatggggaaactgagcagtccatccataccgcagtgaatgagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccactttatttacagtaagtgtatttaagtgaaatttaaaggaatagtgtagctgtttaataactgttgaatggtagatttatgttttttacttgtgattttttgtaggtcctgtgtctgatgatgagtcaccttctcctgattcaactacctcacctcctgaaattcaggcgcccgcacctgcaaacgtatgcaagcccattcctgtaaagcctaagcctgggaaacgccctgctgtggataagcttgaggacttgttggagggtggggatggacctttggaccttagtacccggaaactgccaaggcaata

SEQ ID NO: 67 - DNA, 504 bp, Adenovirus 7 FS Navy
ccagcacattctttgacattaggggggtgcttgatagaggtcctagcttcaagccatattccggcacagcttacaattcactggctcctaagggcgcgcctaacacatctcagtggatagttacaacgggagaagacaatgccaccacatacacatttggcattgcttccacgaagggagacaatattactaaggaaggtttagaaattgggaaagacattactgcagacaacaagcccatttatgccgataaaacatatcagccagagcctcaagttggagaagaatcatggactgatattgatggaacaaatgaaaaatttggaggtagagctcttaaaccagctactaaaatgaagccatgctacgggtcttttgcaagacctacaaacataaaagggggccaagctaaaaacagaaaagtaacaccaaccgaaggagatgttgaagctgaggagccagatattgatatggaatttttcgatggtagagaagctgctgacg

SEQ ID NO: 68 - DNA, 975 bp, Adenovirus 7 FS Navy
tggctttacacaaagcccagacggagttcttactttaaaatgtttaaccccactaacaaccacaggcgggtctctacagttaaaagtgggagggggtcttacaatagatgacaccgacggttttttgaaagaaaacataagtgccaccacaccactcgttaagactggtcactctataggtttgtcgctaggacccggattaggaacaaatgaaaacaaactttgtgccaaattgggagaaggacttacattcaattccaacaacatttgcattaatgacaatattaacaccctatggacaggagttaaccccaccagagccaactgtcaaataatggcctccagtgaatctaatgattgcaaattaattctaacactagttaaaactggagccctcgtcactgcatttgtttatgttataggagtatctaacgattttaatatgctaactacacataaaaatataaatttcactgcagagctgttttttgattctactggtaatttattaactagcctttcatccctaaaaactccacttaatcataaatcagggcaaaacatggctactggtgcccttactaatgctaaaggtttcatgcccagcacaactgcctatcctttcaatgttaattccagagaaaaagaaaactacatttacggaacttgttactacacagctagtgatcacactgcttttcccattgacacatctgtcatgcttaaccaaagagcattaaataatgagacatcatattgtattcgtgtaacttggtcctggaatacaggagttgccccagaagtgcaaacctctgctactaccctagtcacctctccatttaccttttactacattagagaagacgactgacaaataaagtttaacttgtttatttaaaatcaattcataaaattcgagtagttattttgcctcccccttcccatttaacagaatacaccaatctctccccacgc

SEQ ID NO: 69 - DNA, 878 bp, Adenovirus 16
tgagacacctgcgattcctgccacaggagattatctccagcgagaccgggatcgaaatactggagtttgtggtaaataccctgatgggagatgacccggaaccgccagtgcagcctttcgatccacctacgctgcacgatctgtatgatttagaggtagacgggcctgatgatcccaatgaggaagctgtaaatgggttttttactgattctatgctgctagctgccgatgaaggattggacataaaccctcctcctgagacccttgataccccaggggtggttgtggaaagcggcagaggtgggaaaaaattgcctgatctgggagcagctgaaatggacttgcgttgttatgaagagggttttcctccgagtgatgatgaagacggggaaactgaacagtccatccataccgcagtgaatgagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccactttatttacagtaagtgtatttaagtgaaatttaaaggaatagtgtagctgtttaataactgttgaatggtagatttatgtttttgcttgcgattttttgtaggtcctgtgtctgatgatgagtcaccttctcctgattcaactacctcacctcctgaaattcaggcgcccgtacctgcaaacgtatgcaagcccattcctgtgaagcctaagtctgggaaacgccctgctgtggataagcttgaggacttgttggagggtggggatggacctttggaccttagtacccggaaactgccaaggcaatga

SEQ ID NO: 70 - DNA, 667 bp, Adenovirus 16
cgttgaccgggaagacaatacctactcttacaaagttcgctacacgctggctgtaggggacaacagagtactggatatggccagcacgttctttgacatccgcggcgtgctggaccggggccctagcttcaaaccctactccgggaccgcctacaacagcctggctcccaagggagcgcccaacacctgccagtggaaggattctgacagcaaaatgcatacctttggggtagctgccatgcccggtgttactgggaaaaagatagaagctgatgggctgcctattggaatagattcaacttctggaactgacacagtaatttatgctgataaaactttccaaccagaaccacaagttggaaatgccagttgggttgacgccaatggtacagaggaaaaatatggaggcagagctctgaaggacactacaaagatgaaaccctgctatggttctttcgccaagcctaccaacaaagaaggtggtcaggctaacttaaaagattcagaaaccgccgccaccactcctaactatgatatagatctggctttctttgacaacaaaaatattgctgctaactacgatccagatattgtaatgtacacagaaaatgttgacttgcagactccagatactcatattgtatacaaacctggaacagaggacacc

SEQ ID NO: 71 - DNA, 652 bp, Adenovirus 16
gggagatgggttggtaacaaaggatgataaactatgtttatcgctgggagatgggttaataacaaaaaatgatgtactatgtgccaaactaggacatggccttgtgtttgactcttccaatgctatcaccatagaaaacaacaccttgtggacaggcgcaaaaccaagcgccaactgtgtaattaaagagggagaagattccccagactgtaagctcactttagttctagtgaagaatggaggactgataaatggatacataacattaatgggagcctcagaatatactaacaccttgtttaaaaacaatcaagttacaatcgatgtaaacctcgcatttgataatactggccaaattattacttacctatcatcccttaaaagtaacctgaactttaaagacaaccaaaacatggctactggaaccataaccagtgccaaaggcttcatgcccagcaccaccgcctatccatttataacatacgccactgagaccctaaatgaagattacatttatggagagtgttactacaaatctaccaatggaactctctttccactaaaagttactgtcacactaaacagacgtatgttagcttctggaatggcctatgctatgaatttttcatggtctctaaatgcagaggaagcc

SEQ ID NO: 72 - DNA, 878 bp, Adenovirus 21
tgagacacctgcgattcctgccacaggagattatctccagcgagaccgggatcgaaatactggagtttgtggtaaataccctgatgggagatgacccggaaccgccagtgcagcctttcgatccacctacgctgcacgatctgtatgatttagaggtagacgggcctgatgatcccaatgaggaagctgtaaatgggttttttactgattctatgctgctagctgccgatgaaggattggacataaaccctcctcctgggacccttgataccccaggggtggttgtggaaagcggcagaggtgggaaaaaattgcctgatctgggagcagctgaaatggacttgcgttgttatgaagagggttttcctccgagtgatgatgaagatggggaaactgaacagtccatccataccgcagtgaatgagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccactttatttacagtaagtgtatttaagtgaaatttaaaggaatagtgtagctgtttaataactgttgaatggtagatttatgtttttacttgcgattttttgtaggtcctgtgtctgatgatgaggcgccttctcctgattcaactacctcacctcctgaaattcaggcgcccgtacctgcaaacgtatgcaagcccattcctgtgaagcctaagtgtgggaaacgccctgctgtggataagcttgaggacttgttggagggtggggatggacctttggaccttagtacccggaaactgccaagacaatga

SEQ ID NO: 73 - DNA, 807 bp, Adenovirus 21
cgccacagacacctacttcaatctggggaacaagtttaggaaccccaccgtggcgcccacccatgatgtgaccaccgaccgcagtcagcggctgatgctgcgctttgtgcccgttgaccgggaagacaatacctacgcatacaaagttcgatacaccttggctgtgggcgacaacagagtgctggatatggccagcactttctttgacattcggggtgtgttggatagaggccctagcttcaagccatactctggcactgcttacaactcgttggcccctaagggcgctcccaatacatctcagtggattgctgaaggcgtaaaaaaagaagatgggggatctgacgaagaggaagagaaaaatctcaccacttacacttttggaaatgccccagtgaaagcagaaggtggtgatatcactaaagacaaaggtcttccaattggttcagaaattacagacggcgaagccaaaccaatttatgcagataaactataccaaccagaacctcaggtgggagatgaaacttggactgacacagatggaacaactgagaagtatggtggtagagctctaaagccagaaactaaaatgaaaccctgctatgggtcttttgctaaacccactaacgtcaaaggcggacaggcaaaacaaaaaactactgaacaaccgcaaaaccagcaggttgaatatgatattgacatgaacttttttgatgaagcgtcacagaaagcaaacttcagtccaaaaattgtgatgtatgcagaaaatgtagacttggaaaccccagacactcatgtggtgtacaa

SEQ ID NO: 74 - DNA, 685 bp, Adenovirus 21
gctcagtgattccttcaaccctgtctacccctatgaagatgaaagcacctcccaacacccctttataaacccagggtttatttccccaaatggctttacacaaagcccagacggagttcttactttaaattgtttaaccccactaacaaccacaggcgggcctttacagttaaaagtgggagggggacttatagtggatgacactgatgggaccttacaagaaaacatacgtgctacagcacccattactaaaaataatcattctgtagaactatccattggaaatggattagaaacacaaaacaataaactatgtgccaaattgggaaatgggttaaaatttaacaacggtgacatttgtataaaggatagtattaacaccttatggactggaataaagcctccacctaactgtcaaattgtggaaaacactgatacaaacgatggcaaacttactttagtattagtaaaaaacggagggcttgttaatggctacgtatctctagttggtgtatcagacactgtgaaccaaatgttcacacaaaagtcagcaaccatacaattaagattatatttcgactcttctggaaatctattaactgatgaatcaaacttaaaaattccacttaaaaataaatcttctacagcaaccagtgaagctgcaaccagcagcaaagcctttatg

SEQ ID NO: 75 - DNA, 872 bp, Adenovirus 11
tgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataa

SEQ ID NO: 76 - DNA, 677 bp, Adenovirus 11
cgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaag

SEQ ID NO: 77 - DNA, 977 bp, Adenovirus 11
tgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactga

SEQ ID NO: 78 - DNA, 872 bp, Adenovirus 35
tgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtgaatggcttttttaccgattctatgcttttagctgctaatgaaggattagaattagatccgcctttggacactttcaatactccaggggtgattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgatattcaagcacctgttcctgtggacgtgcgcaagcccattcctgtgaagcttaagcctgggaaacgtccagcagtggagaaacttgaggacttgttacagggtggggacggacctttggacttgagtacacggaaacgtccaagacaataa

SEQ ID NO: 79 - DNA, 689 bp, Adenovirus 35
cgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggcgtgttggacagaggtcccagtttcaaaccctattctggtacggcttacaactctctggctcctaaaggcgctccaaatgcatctcaatggattgcaaaaggcgtaccaactgcagcagccgcaggcaatggtgaagaagaacatgaaacagaggagaaaactgctacttacacttttgccaatgctcctgtaaaagccgaggctcaaattacaaaagagggcttaccaataggtttggagatttcagctgaaaacgaatctaaacccatctatgcagataaactttatcagccagaacctcaagtgggagatgaaacttggactgacctagacggaaaaaccgaagagtatggaggcagggctctaaagcctactactaacatgaaaccctgttacgggtcctatgcgaagcctactaatttaaaaggtggtcaggcaaaaccgaaaaactcggaaccgtcgagtgaaaaaa

SEQ ID NO: 80 - DNA, 971 bp, Adenovirus 35
tgaccaagagagtccggctcagtgactccttcaaccctgtctacccctatgaagatgaaagcacctcccaacacccctttataaacccagggtttatttccccaaatggcttcacacaaagcccagacggagttcttactttaaaatgtttaaccccactaacaaccacaggcggatctctacagctaaaagtgggagggggacttacagtggatgacactgatggtaccttacaagaaaacatacgtgctacagcacccattactaaaaataatcactctgtagaactatccattggaaatggattagaaactcaaaacaataaactatgtgccaaattgggaaatgggttaaaatttaacaacggtgacatttgtataaaggatagtattaacaccttatggactggaataaaccctccacctaactgtcaaattgtggaaaacactaatacaaatgatggcaaacttactttagtattagtaaaaaatggagggcttgttaatggctacgtgtctctagttggtgtatcagacactgtgaaccaaatgttcacacaaaagacagcaaacatccaattaagattatattttgactcttctggaaatctattaactgaggaatcagacttaaaaattccacttaaaaataaatcttctacagcgaccagtgaaactgtagccagcagcaaagcctttatgccaagtactacagcttatcccttcaacaccactactagggatagtgaaaactacattcatggaatatgttactacatgactagttatgatagaagtctatttcccttgaacatttctataatgctaaacagccgtatgatttcttccaatgttgcctatgccatacaatttgaatggaatctaaatgcaagtgaatctccagaaagcaacatagctacgctgaccacatccccctttttcttttcttacattacagaagacgacaactaa

SEQ ID NO: 81 - DNA, 986 bp, Adenovirus 1
tgagacatattatttgccacggaggtgttattaccgaagaaatggccgccagtcttttggaccagctaatcgaagaggtactggctgataatcttccacctcctagccattttgaaccacctacccttcacgaactgtatgatttagacgtgacggcccccgaagatcccaacgaggaggcggtttcgcagatttttcctgactctgtaatgttggcggcgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcagcccgggcacggttgcaggtcttgtcattatcatcggaggaatacgggggacccagatattatgtgttcgctttgctatatgaggacctgtggcatgtttgtctacagtaagtgaaattatgggcagtgggtgatagagtggtgggttcggtgtggtaattttttttttaattttttgcagttttgtggtttaaagaattttgtattgtgattttttttaaaaggtcctgtgtctgaacctgagcctgagcccgagccagaaccggaacctgcaagacctgcccggcgtcctaaaatggtgcctgctatcctgagacgcccgacatcacctgtgtccagagaatgcaatagtagtacggatagctgtgactccggtccttctaacacacctcctgagatacatccggtggtcccgctgtgccccattaaaccagttgccgtgagagttggtgggcgtcgccgggctgtggaatgtatcgaggacttgcttaacgagcctgggcaacctttggacttgagctgtaaacgccccaggccataa

SEQ ID NO: 82 - DNA, 715 bp, Adenovirus 1
agtggtcttacatgcacatctcgggccaggacgcctcggagtacctgagccccgggctggtgcagttcgcccgcgccaccgagacgtacttcagcctgaataacaagtttagaaaccccacggtggcgcctacgcacgacgtgaccacagaccggtctcagcgtttgacgctgcggtttatccccgtggaccgcgaggataccgcatactcgtacaaggcgcggtttaccctggctgtgggtgacaaccgtgtgcttgacatggcttccacatactttgacattcgcggcgtgctggaccggggccccacttttaagccctactccggcactgcctacaacgctctagcccccaaaggcgctcccaattcctgcgagtgggaacaagaagaaccaactcaggaaatggctgaagaacttgaagatgaggaggaggcagaggaggaggaggcagaggaggaggcagaagcaccacaagctgatcagaaggttaagaagactcatgtatatgctcaggctcctttggcaggggaaaaaattaccgccaatggcttacaaatagtttctgatacccaaactgaaggcaatccagtttttgccgatcccacttatcaacctgaacctcaggttggagaatctcagtggaatgaagctgaagcaactgcatctggaggcagagtactaaaaaagactactcccatgaaaccatgctacgg

SEQ ID NO: 83 - DNA, 750 bp, Adenovirus 1
gatgctgttgcaatacatgcagcacaaggtctagaatttggtaatgatacgtcaacaaatacaaacccacttaaaacaaaactaggattgggattggactatgactcaaacggtggtatgattcccaaacttggaacaggccttagttttgatactacaggggctataacagtgggaaacaaaagcgatgacaaacttaccctgtggacaactcctgacccatcacctaattgtcaaatacactcagaaaaagatgctaagctaacactagttttaactaaatgcggcagtcaggtacttgcaactgtgtcagcactggctgtaaggggcagcctagctcctattagcggaacaataagtagtgctcacattattctcagatttaatgaacatggagtgctaatgaatcattctagtttggatccccaatactggaatttcagaaaaggggatttaacaaacgctacagcatatactaacgcagttggttttatgcccaaccttaaagcttacccaaaaactcaaagtagaactgcaaaaagcaacattgttagtcaggtttatcttaatggagaaaaagaaaaaccaatgacactcactattacacttaatggaactgatgaaaatcaaaccactcccgccagtacatactcaatttcattttcatggagctggcctagcaatcaaacatacattggtcaaacatttgccactaattcctacaccttctcctacattgcccaagaataa

SEQ ID NO: 84 - DNA, 983 bp, Adenovirus 2
tgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtcggtgatagagtggtgggtttggtgtggtaatttttttttaatttttacagttttgtggtttaaagaattttgtattgtgattttttaaaaggtcctgtgtctgaacctgagcctgagcccgagccagaaccggagcctgcaagacctacccggcgtcctaaattggtgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataa

SEQ ID NO: 85 - DNA, 837 bp, Adenovirus 2
agtggtcttacatgcacatctcgggccaggacgcctcggagtacctgagccccgggctggtgcagtttgcccgcgccaccgagacgtacttcagcctgaataacaagtttagaaaccccacggtggcacctacgcacgacgtaaccacagaccggtcccagcgtttgacgctgcggttcatccctgtggaccgcgaggataccgcgtactcgtacaaagcgcggttcaccctggctgtgggtgacaaccgtgtgcttgatatggcttccacgtactttgacatccgcggcgtgctggacagggggcctacttttaagccctactccggcactgcctacaacgctctagctcccaagggcgctcctaactcctgtgagtgggaacaaaccgaagatagcggccgggcagttgccgaggatgaagaagaggaagatgaagatgaagaagaggaagaagaagagcaaaacgctcgagatcaggctactaagaaaacacatgtctatgcccaggctcctttgtctggagaaacaattacaaaaagcgggctacaaataggatcagacaatgcagaaacacaagctaaacctgtatacgcagatccttcctatcaaccagaacctcaaattggcgaatctcagtggaacgaagctgatgctaatgcggcaggagggagagtgcttaaaaaaacaactcccatgaaaccatgctatggatcttatgccaggcctacaaatccttttggtggtcaatccgttctggttccggatgaaaaaggggtgcctcttccaaaggttgacttgcaattcttctcaaatactacctctttgaacgaccggc

SEQ ID NO: 86 - DNA, 750 bp, Adenovirus 2
atagctataaatgcaggaaagggtctggagtttgatacaaacacatctgagtctccagatatcaacccaataaaaactaaaattggctctggcattgattacaatgaaaacggtgccatgattactaaacttggagcgggtttaagctttgacaactcaggggccattacaataggaaacaaaaatgatgacaaacttaccctgtggacaaccccagacccatctcctaactgcagaattcattcagataatgactgcaaatttactttggttcttacaaaatgtgggagtcaagtactagctactgtagctgctttggctgtatctggagatctttcatccatgacaggcaccgttgcaagtgttagtatattccttagatttgaccaaaacggtgttctaatggagaactcctcacttaaaaaacattactggaactttagaaatgggaactcaactaatgcaaatccatacacaaatgcagttggatttatgcctaaccttctagcctatccaaaaacccaaagtcaaactgctaaaaataacattgtcagtcaagtttacttgcatggtgataaaactaaacctatgatacttaccattacacttaatggcactagtgaatccacagaaactagcgaggtaagcacttactctatgtcttttacatggtcctgggaaagtggaaaatacaccactgaaacttttgctaccaactcttacaccttctcctacattgcccaggaataa

SEQ ID NO: 87 - DNA, 985 bp, Adenovirus 5
tgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataa

SEQ ID NO: 88 - DNA, 732 bp, Adenovirus 5
agtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaacagaaattaatcatgcagctgggagagtcctaaaaaagactaccccaatgaaaccatgttacggttcatatgcaaaacccacaaatgaaaatggagggcaaggcattcttgtaaagc

SEQ ID NO: 89 - DNA, 747 bp, Adenovirus 5
acagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataa

SEQ ID NO: 90 - DNA, 985 bp, Adenovirus 6
tgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaaattatgggcagtgggtgatagagtggtgggtttggtgtggtaattttttttttaatttttacagttttgtggtttaaagaattttgtattgtgattttttaaaaggtcctgtgtctgaacctgagcctgagcccgagccagaaccggagcctgcaagacctacccggcgtcctaaattggtgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataa

SEQ ID NO: 91 - DNA, 833 bp, Adenovirus 6
gaatgaagccaatgaagctcaggcgcgagaacaggaacaagctaagaaaacccatgtatatgcccaggctccactgtccggaataaaaataactaaagaaggtctacaaataggaactgccgacgccacagtagcaggtgccggcaaagaaattttcgcagacaaaacttttcaacctgaaccacaagtaggagaatctcaatggaacgaagcggatgccacagcagctggtggaagggttcttaaaaagacaactcccatgaaaccctgctatggctcatacgctagacccaccaattccaacggcggacagggcgtgttatggttgacaaatggtaaattggaaagtcaagtcgaaatgcaatttttttccacatccacaaatgccacaaatgaagttaacaatatacaaccaacagttgtattgtacagcgaagatgtaaacatggaaactccagatactcatctttcttataaacctaaaatgggggataaaaatgccaaagtcagtcttggacaacaagcaatgccaaacagaccaaattacattgcttttagagacaattttattggtctcatgtattacaacagcacaggtaacatgggtgtccttgctggacaggcatcgcagttgaacgctgttgtagatttgcaagacagaaacacagagctgtcctaccagcttttgcttgattcaattggcgacagaacaagatacttttcaatgtggaatcaagctgttgacagctatgatccagatgtcagaattattgagaaccatggaactgaggatgagttgccaaattattgctttcctcttggtggaattggga

SEQ ID NO: 92 - DNA, 750 bp, Adenovirus 6
tcctcaaacggaaatcccataaaaacaaaaattggatcaggcatacaatataataccaatggagctatggttgcaaaacttggaacaggcctcagttttgacagctccggagccataacaatgggcagcataaacaatgacagacttactctttggacaacaccagacccatccccaaattgcagaattgcttcagataaagactgcaagctaactctggcgctaacaaaatgtggcagtcaaattttgggcactgtttcagctttggcagtatcaggtaatatggcctccatcaatggaactctaagcagtgtaaacttggttcttagatttgatgacaacggagtgcttatgtcaaattcatcactggacaaacagtattggaactttagaaacggggactccactaacggtcaaccatacacttatgctgttgggtttatgccaaacctaaaagcttacccaaaaactcaaagtaaaactgcaaaaagtaatattgttagccaggtgtatcttaatggtgacaagtctaaaccattgcattttactattacgctaaatggaacagatgaaaccaaccaagtaagcaaatactcaatatcattcagttggtcctggaacagtggacaatacactaatgacaaatttgccaccaattcctataccttctcctacattgcccaggaataaagaatcgtgaacctgttgcatgttatgtttcaacgtgtttatttttcaattgcagaaaat

SEQ ID NO: 93 - DNA, 865 bp, Adenovirus 4
tgaggcacctaagagacctgcccgatgaggaaattatcatcgcttccgggagcgagattctggaactggtggtaaatgctatgatgggcgacgaccatccggaaccccccaccccatttgagacaccttcgctgcacgatttgtatgatctggaggtggatgtgcccgaggacgaccccaacgagaaggcggtaaatgatttatttagcgatgccgcgctgctagctgccgaggaggcttcaagccctagctcagacagcgactcttcactgcatacccctagacacgacagaggtgagaaagagatccccgggcttaaatgggaaaagatggacttgcgttgctatgaggaatgcctgcccccaagcgatgatgaggacgagcaggcgattcagaacgcagcgagccatggagtgcaagccgtcagcgagagctttgcactggactgcccgcctttgcccggacacggctgtaagtcttgtgaatttcatcgcatcaatactggagataaagctgtgttatgtgcactttgctatatgagagcgtacaaccattgtgtttacagtaagtgtgattaagtgaactttaaagggaggcaaagagtagggtgactgggtgatgactggtttatttatgtatatctgttttttatataggtcccgtttctgacgcagatgatgagacccccactacagagtccactttgtcaccccctgaaattggcacgtctccatctgacaatattgttagaccagttcctgtaagagccactgggaggagagcagctgtagaatgtttggatgatttgcttcagggtggagatgaacctttggacttgtgtacccggaaacgccccaggcattaa

SEQ ID NO: 94 - DNA, 2810 bp, Adenovirus 4
tggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcctacccacgatgtgaccaccgaccgcagccagcggctgacgctgcgctttgtgcccgtggaccgggaggacaacacctactcgtacaaagtgcgctacacgctggccgtgggcgacaaccgcgtgctggacatggccagcacctactttgacatccgcggcgtgctggatcggggccctagcttcaaaccctactccggcactgcctacaacagcctggctcccaagggagcgcccaacacctgccagtggaaggattctgacagcaaaatgcatacctttggggcagctgccatgcccggtgttactgggaaaaagatagaagctgatgggctgcctattagaatagattcaacttctggaactgacacagtaatttatgctgataaaactttccaaccagaaccacaagttggaaatgacagttgggttgacaccaatggtgcagaggaaaaatatggaggcagagctctaaaggacactacaaaaatgaaaccctgttatggttcattcgccaagcctaccaacaaagaaggtggtcaggctaacttaaaagattcagaacccgccgccaccactcctaactatgatatagacctggctttctttgacagcaaaactattgttgctaactacgatccagatattgtaatgtacacagaaaatgttgacttgcagactccagatactcatattgtatacaaacctggaacagaggacaccagctctgaatccaatttgggtcagcaggccatgcctaacagacccaactacattggcttcagagacaattttatcgggctcatgtactacaacagcactggcaatatgggggtgctggccggtcaggcctctcagctgaatgctgtggttgacttgcaagacagaaacactgaactgtcctaccagctcttgcttgactctctgggtgacagaacccggtatttcagtatgtggaatcaggcggtggacagctatgatcctgatgtgcgcattattgaaaaccatggtgtggaggatgaattgccaaactattgctttccgttgaatggtgtgggattgacagacacttaccagggtgttaaagttaaaacagatgcaggttctgaaaagtgggacaaagatgacaccacagttagtaatgctaatgaaatccatgtaggcaatccttttgccatggaaatcaacatccaagccaacctgtggaggaacttcctctatgccaatgttgccctctatttgcctgataaatacaaatacacaccggccaacatcaccctgcccaccaacaccaacacctacgagtacatgaacggccgggtggtggcgccctcgctggtggacgcctacattaacattggggcgcgctggtcgctggaccccatggacaacgtaaatcccttcaaccaccaccgcaatgcgggcttgcgctaccgctccatgctcctgggcaacgggcgctacgtgccattccacatccaggtgccccagaaattttttgccattaagagcctcctgctcctgcccgggtcctacacctacgagtggaacttccgcaaggacgtcaacatgatcctgcagagttcccttggcaacgacctgcgcacagacggggcctccatcaccttcaccagcattaacctctacgccaccttcttccccatggcgcacaacaccgcctccacgcttgaggccatgctgcgcaacgacaccaatgaccaatccttcaacgactacctctcggcggccaacatgctctatcccatcccggccaacgccaccaacgtgcccatctccatcccctcgcgcaactgggccgcctttcgcggctggtccttcacgcgactcaagaccaaagagacgccctcgctgggctccgggttcgacccctacttcgtctactcgggctccatcccctacctcgacggcaccttctacctcaaccacaccttcaagaaggtctccatcaccttcgactcttccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggttaactacaaggactaccaggccgtcaccctggcctaccaacacaacaactcgggcttcgttggatacctcgcgcccactatgcgccagggccagccctaccccgccaactacccctacccgctcatcggcaagagcgccgttaccagcgtcacccagaaaaagttcatctgcgacagggtcatgtggcgcatccccttctccagcaacttcatgtccatgggcgcgctcaccgacctcggccagaacatgctctatgctaactccgcccacgcgctagacatgaatttcgaagtcgaccccatggatgagtccacccttctctatgttgtcttcgaagtcttcgacgtcgtccgagtgcaccagccccaccgcggcgtcattgaggccgtctacctgcgcacccccttctcagccggtaacgccaccacataa

SEQ ID NO: 95 - DNA, 1277 bp, Adenovirus 4
tgtccaaaaagcgcgcgcgggtggatgatggcttcgaccccgtgtatccctacgatgcagacaacgcaccgaccgtgcccttcatcaaccctcccttcgtctcttcagatggattccaagaaaagcccctgggggtgttgtcccttaggctggccgaccctgtcaccaccaagaatggggaaattaccctcaagctgggggagggggtggaccttgacgactcgggaaaactcattgcaaacacagtaaacaaggccattgcccctctcagtttttccaacaacaccatttcccttaacatggatacccctttatacaccaaagatggaaaactatccttacaagtttctccaccattaagtatattaaaatcaacaattttgaatacattagctctagcttttggctcaggtttaggactcagtggcagcgccctggcagtacagttagcctctccacttacatttgatgataaagggaatataaagattaccctaaacaggggattgcatgttacaacaggagatgcaattgaaagcaacatcagttgggctaaaggtataaaatttgaagatggtgccatagctacaaacattggtaaggggctagagttcggaaccagtagtacagaaacaggagttaataatgcttatccaatccaagttaaacttggctctggtctcagctttgacagcacaggagccataatggctggcaataaagactatgataaattaactttgtggacaacgcctgacccatcaccaaactgtcaaatacttgcagaaaatgatgcaaaactaacactttgcttaactaagtgtgacagtcaaatactggccactgtatcagttttggttgttagaagtggaaacttaaacccaattactggcacagtaagcagtgctcaagtttttctacgttttgatgcaaatggtgttcttttaacagaacactctacactaaaaaaatactggggctacaagcaaggagatagcatagatggcactccatacaccaatgctgttggttttatgccaaattcaacagcttatccaaagacccaaagttctactactaaaaataatatagtgggtcaagtatacatgaatggagatgtttcaaaacccatgcttcttactataactcttaatggtactgatgacaccaccagtgcatactcaatgtcattttcatacacctggactaacggaagctatatcggagcaacatttggagctaactcatacaccttctcctacatagcccaacaataa

SEQ ID NO: 96 - DNA, 832 bp, Adenovirus 4 FS AF
tgaggcacctgagagacctgcccgatgagaaaattattatcgcttccgggagcgagattctggaactggtggtaaatgctataatgggcgacgaccatccggaaccccccaccccatttgagacaccttcgctgcacgatttgtatgatctggaggtggatgtgcccgaggacgaccccaacgaggaggcggtaaatgatttatttagcgatgccgcgctgctagctgccgaggaggctttaagccctagacacggcagaggtgataaaaagatcccctggcttaaaggggaagagatggacttgcattgctatgaggaatgcttgcccccgagcgatgatgagtacgagcaggcgatccagaacgcagcgagccagggagtgcaagccgccagcgagagctttgcactggactgcccacctttgcccggacacggctgtaagtcttgtgaatttcatcgtatgaatactggagataaagctgtgttatgtgcactttgctatatgagagcgtacaaccattgtgtttacagtaagtgtgattaagtgaactttagagggaggcagagagtagggtgactgggcaatgactggtttatttatgtatatctgttttttatataggtcccgtctctgatgcagatgatgaaacccccactacagagtccactttgttaccccctgaaattggcacgtccccacctaagaatattattagaccagttcctgtaaaagccactgggaggagagcagctgtggaatgtttggatgatttgcttcagggtggggatgaacctttggacttgtgtacccggaaacgccccagacattaa

SEQ ID NO: 97 - DNA, 2810 bp, Adenovirus 4 FS AF
tggccaccccatcgatgctgccccagtgggcgtacatgcacatcgccggacaggacgcttcggagtacctcagtccgggtctggtgcagttcgcccgcgccacagacacctacttcagtctggggaacaagtttagaaaccccacggtggcgcctacccacgatgtgaccaccgaccgcagccagcggctgacgctgcgcttcgtgcccgtggaccgggaggacaacacctactcgtacaaagtgcgctacacgctggccgtgggcgacaaccgtgtgctggacatggccagcacctactttgacatccgcggcgtgctggaccggggccctagctttaaaccctactccggcactgcctacaacagtctggctcccaagggagcgcccaatacctgccagtggaaggatgctaacagcaaaatgcatacctttggggtagctgccatgccaggtgttactgggaaaaagatagaagctgatgggctgcctattagaatagattcaacttctggaactgacacagtaatttatgctgataaaactttccaaccagaaccacaagttggaaatgacagttgggttgacaccaatgatgcagaggaaaaatatggaggcagagctctaaaggacactacaaatatgaaaccctgctatggttcattcgccaagcctaccaacaaagaaggtgggcaggctaacttaaaagattcagaaaccgccgccaccactcctaactatgatatagatctggctttctttgacggcaaaaatattgttgctaactacgatccagatattgtaatgtacacagaaaatgttgacttgcagactccagatactcatattgtatacaaacctggaaaagaggacaccagctctgaatccaatttgggtcagcaggccatgcctaacagacccaactacattggcttcagagacaattttatcgggctcatgtactacaacagcactggcaatatgggggtactggccggtcaggcctctcagctgaatgctgtggttgacttgcaagacagaaacactgaactgtcctaccagctcttgcttgactctttaggcgacagaacccggtatttcagtatgtggaatcaggcggtggacagctatgatcctgatgtgcgcattattgaaaaccatggtgtggaggatgaattgccaaactattgctttccgttaaatggtgtgggattgacagacacttaccagggtgttaaagttaaaacagatgcaggttctgaaaagtgggacaaagatgacaccacagttagtactgctaatgaaatccatgtaggcaatccttttgccatggaaatcaacatccaagccaacctgtggaggaacttcctctatgccaatgttgccctctatttgcctgataaatacaaatacacaccggccaacatcaccctgcccaccaacaccaacacctacgagtacatgaatggccgggtggtggcgccatcgctggtggacgcctacattaacatcggagcacgctggtcgctggaccccatggacaacgtaaatcccttcaaccaccaccgtaacgcgggcttgcgctaccgctccatgcttctgggcaacgggcgctacgtgccattccacatccaggtgccccagaaatttttcgccatcaagaaccttttgctcctgcccgggtcctatacctacgagtggaacttccgcaaggacgtcaacatgatcttgcagagttcccttggcaacgacctgcgcacagacggggcctccatcaccttcaccagcatcaacctctacgctaccttcttccccatggcgcacaacaccgcctccacgcttgaggccatgctgcgcaacgacaccaatgaccagtcctttaacgactacctctcggcggccaacatgctataccccatcccggccaatgccaccaacgtgcccatctccatcccctcgcgcaactgggccgcctttcgcggctggtccttcacgcgtctcaagaccaaagagacgccctcgctgggctccgggtttgacccctactttgtctactcgggctccatcccctacctcgacggcaccttttacctcaaccacaccttcaagaaggtttcaatcaccttcgactcttccgtcagctggcccggcaacgaccggctcctgacgcccaacgagtttgaaattaagcgcaccgtggacggcgaggggtacaacgtggcccagtgcaacatgaccaaggactggttcttggtccagatgctggcccattacaacattggctaccagggcttctacgtgcccgagggctacaaggatcgcatgtactctttcttccgcaacttccagcccatgagccgccaggtggtggacgaggttaactacaaggactaccaggccgtcaccctggcctatcagcacaacaactcgggctttgtcggttacctcgcgcccaccatgcgccggggccagccctaccccgccaactacccctacccgctcattggcaaaagcgccgtcaccagcgtcacccagaaaaagttcatctgcgacagggtcatgtggcgcattcccttctccagcaacttcatgtccatgggcgcgctcaccgaccttggccagaacatgctctatgctaactccgcccacgcgctagacatgaatttcgaagtcgaccccatggatgagtctacccttctctatgttgtcttcgaagtcttcgacgtcgtccgagtgcaccagccccaccgcggcgtcattgaggccgtctacctgcgcacccccttctcggccggtaacgccaccacataa

SEQ ID NO: 98 - DNA, 1277 bp, Adenovirus 4 FS AF
tgtccaaaaagcgcgcgcgggtggatgatggcttcgaccccgtgtacccctacgatgcagacaacgcaccgaccatgcccttcatcaaccctcccttcgtctcttcagatggattccaagaaaagcccctgggggtgttgtcccttaggctggccgaccctgtcaccaccaagaatggggaaatcaccctcaatctgggggagggggtggaccttgacgactcgggaaaactcattgcaaacacagtcaacaaggccattgcccctcttagtttttccaacaacaccatttcccttaacatggatacccctttatacaccaaagatggaaaactatccttacaagtttctccaccattaagtatattaagatcaacaattctaaatacattagctctagcttttggctcaggtttaggactgcgtggcagcgctctggcagtacagttagcctctccacttacatttgatgataaagggaatataaagattaccctaaataggggattgcatgttacaacaggaaatgcaattgaaagcaacattagttgggctaaaggtataaaatttgaagatggtgccatagctacaaacattggtaaggggctagagtttggaaccagtagtacagaaacaggagttaataatgcttatccaatccaagttaaacttggatctggtctcagctttgacagcacaggagctataatggctggcaataaagactatgataaattaactttgtggacaacgcctgacccatcaccaaactgtcaaatacttgcagaaaatgatgcaaaactaacactttgcttaactaagtgtgacagtcaaatactggccactgtatcagttttggttgttagaagtggaaacttaaacccaattactggcacagtaagcagtgctcaagtttttctacgttttgatgcaaacggtgttcttttaacagaacactctacactaaaaaaatactggggctacaggcaaggagatagcatagatggcactccatacaccaatgctgttggtttcatgccaaattcaacagcttatccaaagacccaaagttctactactaaaaataatatagtgggacaagtatacatgaatggagatgtttcaaaacccatgcttcttactataactcttaatggtactgatgacaccaccagtgcatactcaatttcattttcatacacctggactaacggaagctatatcggagcaacatttggagctaactcatacaccttctcctacatagcccaagaataa

SEQ ID NO: 99 - DNA, 597 bp, Adenovirus 12
atgagaactgaaatgactcccttggtcctgtcgtatcaggaagctgacgacatattggagcatttggtggacaacttttttaacgaggtacccagtgatgatgatctttatgttccgtctctttacgaactgtatgatcttgatgtggagtctgccggtgaagataataatgaacaggcggtgaatgagttttttcccgaatcgcttattttagctgccagtgaggggttgtttttaccggagcctcctgtactttctcctgtctgtgagcctattgggggcgaatgtatgccacaactgcaccctgaagatatggatttattgtgctacgagatgggctttccctgtagcgattcggaagacgagcaagacgagaacggaatggcgcatgtttctgcatccgcagctgctgctgccgctgatagggaacgtgaggagtttcagttagaccatccagagttgcccggacacaattgtaagtcctgtgagcaccaccggaatagtactggaaatactgacttaatgtgctctttgtgctatctgcgagcctacaacatgttcatttacagtaagtgtgctatgggaggtgggaggtga

SEQ ID NO: 100 - DNA, 884 bp, Adenovirus 12
cctacttcaccctgggaaacaagtttagaaaccccaccgtggctcccacccatgatgttaccaccgatcgctcgcagcgtctgacgctgcgttttgtgcccgtggatcgggaagatactacctactcctacaaggctcgctttacgctggctgtgggtgacaaccgcgtgttagacatggctagttcttactttgacattcgaggggtactggatcgtggtcccagttttaagccctattccggaaccgcctacaattctttggcaccaaaaggcgctcctaatgcttcacaatggtcagataacgctaagcttaatacctttgctcaggcgccgtatcttagcgacactatcaccgccgccgatggtattaaagttggaacagacaccgcccaggcaggcgcggcggtgtatgccaacaaaacttatcagccagagccgcaagtaggaccaagtgaatggaacaccagcattgaaaacgttaaagctggcgggagggcattaaagcaaaccactgcaatgcagccgtgctatggctcctacgctcgtccaaccaacgaacacggaggacaatccaaggatgacaacattgaacttaagttctttgattcagctaacaatgcagcaaacactgctcaagttgtgttctataccgaagacgtaaaccttgaaatgccagacacgcatcttgtgtttaagcctactgttaccaatggaacaattgcttctgagtcgctgttgggacagcaagcagcgccaaatagagcaaactacattgcattcagagataattttattggcctgatgtattacaacagtacaggcaacatgggtgtattggccgggcaagcttcccaacttaacgcagtagtagacctgcaagac

SEQ ID NO: 101 - DNA, 908 bp, Adenovirus 12
cagcagaacccagtatgctgaagaaacagaagaaaatgatgacttcaaccccgtttacccttttgacccatttgacacatcagacgtaccctttgttacacccccttttacttcttccaatggtcttcaagaaaaaccaccaggtgtattagcacttaattacaaagaccccattgtaactgaaaatggaacccttacactcaagctaggggacggaataaaacttaatgcccaaggtcaacttacagctagtaataatatcaatgttttggagccccttaccaacacctcacaaggtcttaaactttcttggagcgcccccctagcagtaaaggctagtgccctcacacttaacacaagagcgcccttaaccacaacggatgaaagcttagccttaataaccgcccctcccattacagtagagtcttcgcgtttgggcttggccaccatagcccctctaagcttagatggaggtggaaacctaggtttaaatctttctgctcccctggacgttagtaacaacaatttgcatctcaccactgaaactcccttagttgtaaattctagcggtgccctatctgttgctactgcagaccccataagtgttcgcaacaacgctcttaccctacctacggcagatccgttaatggtgagctccgatgggttgggaataagtgtcactagtcccattacagtaataaacggttccttagccttgtctacaactgctcccctcaacagcacaggatccactttaagtctgtctgttgccaatcctctgactatttcacaagacacattgactgtttccactggtaacggtcttcaagtgtcggggtctcaattagtaacaagaataggggatggtttaacattcgataatggggtcatgaaagtaaacgttgccg

SEQ ID NO: 102 - DNA, 579 bp, Adenovirus 17
atgagacacctgcgcctcctgcctggaactgtgcccttggacatggccgcattattgctggatgactttgtgagtacagtattggaggatgaactgcaaccaactccgttcgagctgggacccacacttcaggacctctatgatttggaggtagatgcccaggaggacgacccgaacgaagatgctgtgaatttaatatttccagaatctctgattcttcaggctgacatagccagcgaagctctacctactccacttcatactccaactctgtcacccatacctgaattggaagaggaggacgagttagacctccggtgttatgaggaaggttttcctcccagcgattcagaggacgaacagggtgagcagagcatggctctaatctcagactatgcttgtgtggttgtggaagagcattttgtgttggacaatcctgaggtgcccgggcaaggctgtaaatcctgccagtaccaccgggataagaccggagacacgaacgcctcctgtgctctgtgttacatgaaaaagaacttcagctttatttacagtaagtggagtgaatgtgagagaggctga

SEQ ID NO: 103 - DNA, 692 bp, Adenovirus 17
cttcagcctgggcaacaagtttaggaaccccacggtggccccgacccacgatgtgaccacggaccggtcccagcgtctgacgctgcgctttgtgcccgtggatcgcgaggacaccagtactcgtacaaggcgcgcttcactctggccgtgggcgacaaccgggtgctagacatggccagcacgtactttgacatccgcggcgtcctggaccgcggtcccagtttcaaaccctactcgggcacggcttacaacagccttgcccccaagggcgctcccaatcccagtcagtgggttgccaaagaaaatggtcagggaactgataagacacatacttatggctcagctgccatgggaggaagcaacatcaccattgaaggtttagtaattggaactgatgaaaaagctgaggatggcaaaaaagatatttttgcaaataaactttatcagccagaacctcaagtaggtgaagaaaactggcaagagtctgaagccttctatggaggcagagctcttaagaaagacacaaaaatgaagccctgctatggctcatttgcaagacctaccaatgaaaaaggcggacaagctaaatttaagccagtggaagaggggcagcaacctaaagattatgacatagatttggctttctttgacacacctggaggcaccatcacaggaggcacagacgaagaata

SEQ ID NO: 104 - DNA, 829 bp, Adenovirus 17
tcctgtcactcaaactggctgacccaatcaccatagccaatggtgatgtctcactcaaggtgggagggggacttactttgcaagaaggaagtatgactgtagaccctaaggctcccttgcaacttgcaaacaataaaaaacttgagcttgtttatgttgatccatttgaggttagtgccaataaacttagtttaaaagtaggacatggattaaaaatattagatgacaaaagtgctggagggttgaaagatttaattggcaaacttgtggttttaacagggaaaggaataggcactgaaaatttgcaaaatacagatggtagcagcagaggaattggtataagtgtaagagcaagagaagggttaacatttgacaatgatggatacttggtagcatggaacccaaagtatgacacgcgcacactttggacaacaccagacacatctcctaattgcaggattgataaggagaaggattcaaaactcactttggtacttacaaagtgtggaagtcaaatattagctaatgtgtctttgattgtggtgtcaggaaaatatcaatacatagaccacgctacaaatccaactcttaaatcatttaaaataaaacttctttttgataataaaggtgtacttctcccaagttcaaaccttgattccacatattggaactttagaagtgacaatttaactgtatctgaggcatataaaaatgcagttgaatttatgcctaatttggtagcctacccaaaacctaccactggctctaaaaaatatgcaagggatatagtctatgggaacatatatcttggaggtttggcatatcagcc

SEQ ID NO: 105 - DNA, 824 bp, Adenovirus 40
cttgagtgcgagcgagtagagttttctcctccattgctgttggcgcttttgacatagccaccaagatgagaatgctgccggatttttttaccgggaactgggatgacatgttccaggggttgctggagactgaatatgtgtttgatttccctgaaccttctgaggcttctgaagaaatgtcgcttcatgatctttttgatgtggaggtggatggtttcgaagaggacgccaaccaggaagcggttgatggtatgtttcccgagaggttgctgtccgaggctgagagcgctgcagagagcggttcgggtgattctggggttggcgaagagttgttgccggttgatctggatttgaaatgctatgaagacggtttgcctcctagcgatcctgaaactgatgaggctacagaggcggaagaagaggcggctatgccgacttatgtgaatgaaaatgaaaatgagctggtgctggactgtccagagaaccctgggcgaggttgtcgggcttgtgatttccatcggggcactagtggcaatcctgaagctatgtgtgctttgtgttatatgcgtttaactggacactgtatctacagtaagtaaaaaagtttttatttgtttggtggtgttggttaatatgaacaagagttaacgactttttgttattttaggtccaatttcagatgcggaaggggagtctgagtcggggtcgcctgaggacactgattttccccaccctttaaccgccacgccgccacatggaattgtgagaaccatcccgtgcagagtttcttgtagacgacgcccagctgttgagtgcatagaaga

SEQ ID NO: 106 - DNA, 876 bp, Adenovirus 40
cgcaatggtcttacatgcacatcgccgggcaggacgcctcggagtacctgagcccgggcctggtgcagttcgcccgtgccaccgatacctacttcagcctggggaacaagttcagaaaccccaccgtggctcccacccacgatgtaaccacagacaggtcgcagcgactgacgctgcgcttcgtgcccgtcgaccgcgaggaaaccgcctactcttacaaagtgcgctttacgctggccgtgggcgacaaccgggttttggacatggccagcacctactttgacatccgcggcgtgctggatcgtggtcccagctttaaaccctattcgggcactgcatacaactccctggcccccaaaggtgctcccaatcctagccagtggacaaaccaaaacaaaacaaactcctttggacaagctccctatataggacaaaaaatcaccaatcagggcgtgcaagtgggctcagactccaacaatcgcgatgtgtttgccgataaaacgtaccaaccggagcctcaagtggggcagacgcaatggaacattaatccaatgcaaaacgctgcgggaagaatactaaaacaaaccacgcccatgcagccatgttatgggtcatacgctagaccaacaaacgaaaaaggaggtcaagccaagctggtaaaaaatgacgacaatcagaccacaacaacaaacgtaggtttaaacttttttaccactgccactgaaaccgctaatttttcaccaaaggtggttctgtacagcgaagatgttaacttagaagcgcccgatacccaccttgtgtttaagccagatgtcaacggcacaagtgccgagcttttactgggacagcaggccgctcccaatcgacctaattaca

SEQ ID NO: 107 - DNA, 707 bp, Adenovirus 40
cactgacagtaagcaacaaccagcttagtattaacactggcagaggcttagttataactaacaatgccgtagcagttaatcctaccggagcgttaggctttaacaacacaggagctttacaattaaacgctgcgggaggaatgagagtggacggcgccaacttaattcttcatgtagcatacccctttgaagcaatcaaccaactaacactgcgattagaaaacgggttagaagtaaccaacggaggaaaactcaacgttaagttgggatcaggcctccaatttgacaataacggacgcattaccattagtaatcgcatccagactcgaggtgtaacatccctcactaccatttggtctatctcgcctacgcctaactgctccatctatgaaacccaagatgcaaatctatttctttgtctaactaaaaacggagctcacgtgttaggtactataacaattaaaggtcttaaaggagcactgcgggaaatgaacgataacgctttatctgtaaaacttccctttgacaatcagggaaatttactcaactgtgccttggaatcatccacctggcgttaccaggaaaccaacgcagtggcctctaatgccttaacatttatgcccaacagtacagtgtatccccgaaacaaaaccgccgacccaggcaacatgctcatccaaatctcgcctaacatcaccttcagtgtc

SEQ ID NO: 108 - DNA, 1692 bp, Influenza A H1N1 (New Caledonia Like)
atgaaagcaaaactactggtcctgttatgtacatttacagctacatatgcagacacaatatgtataggctaccatgccaacaactcaaccgacactgttgacacagtacttgagaagaatgtgacagtgacacactctgtcaacctacttgaggacagtcacaacggaaaactatgtctactaaaaggaatagccccactacaattgggtaattgcagcgttgccggatggatcttaggaaacccagaatgcgaattactgatttccaaggaatcatggtcctacattgtagaaacaccaaatcctgagaatggaacatgttacccagggtatttcgccgactatgaggaactgagggagcaattgagttcagtatcttcatttgagagattcgaaatattccccaaagaaagctcatggcccaaccacaccgtaaccggagtatcagcatcatgctcccataatgggaaaagcagtttttacagaaatttgctatggctgacggggaagaatggtttgtacccaaacctgagcaagtcctatgtaaacaacaaagagaaagaagtccttgtactatggggtgttcatcacccgcctaacataggggaccaaagggccctctatcatacagaaaatgcttatgtctctgtagtgtcttcacattatagcagaagattcaccccagaaatagccaaaagacccaaagtaagagatcaggaaggaagaatcaactactactggactctgctggaacctggggatacaataatatttgaggcaaatggaaatctaatagcgccatggtatgcttttgcactgagtagaggctttggatcaggaatcatcacctcaaatgcaccaatggatgaatgtgatgcgaagtgtcaaacacctcagggagctataaacagcagtcttcctttccagaatgtacacccagtcacaataggagagtgtccaaagtatgtcaggagtgcaaaattaaggatggttacaggactaaggaacatcccatccattcaatccagaggtttgtttggagccattgccggtttcattgaaggggggtggactggaatggtagatgggtggtatggttatcatcatcagaatgagcaaggatctggctatgctgcagatcaaaaaagtacacaaaatgccattaacgggattacaaacaaggtgaattctgtaattgagaaaatgaacactcaattcacagctgtgggcaaagaattcaacaaattggaaagaaggatggaaaacttaaataaaaaagttgatgatgggtttctagacatttggacatataatgcagaattgttggttctactggaaaatgaaaggactttggatttccatgactccaatgtgaagaatctgtatgagaaagtaaaaagccaattaaagaataatgccaaagaaataggaaacgggtgttttgaattctatcacaagtgtaacaatgaatgcatggagagtgtgaaaaatggaacttatgactatccaaaatattccgaagaatcaaagttaaacagggagaaaattgatggagtgaaattggaatcaatgggagtctatcagattctggcgatctactcaactgtcgccagttccctggttcttttggtctccctgggggcaatcagcttctggatgtgttccaatgggtctttgcagtgcagaatatgc

SEQ ID NO: 109 - DNA, 805 bp, Influenza A H2N2 (berkley)
aaggtcgacacaattctagagcggaatgtcactgtgactcatgccaaggacatccttgagaagacccataacggaaagctatgcaaactaaacggaattcctccacttgaactaggggattgtagcattgccggatggctccttggaaatccagaatgtgataggcttctaagtgtgccagaatggtcctatataatggagaaagaaaacccgagatacagtttgtgttatccaggcagcttcaatgactatgaagaattgaaacatctcctcagtagcgtaaaacacttcgagaaagtaaagattctgccaaaagatggatggacacagcatgagacaactggaggttcaaaggcctgcgcagtgtcaggtaaaccatcattcttcaggaacatggtctggctgacaaagaaaggacctaattatccggttgccaaaggatcgtacaacaatacaagcggagagcaaatgctaataatttggggagtgcaccatcctaatgatgaggcagaacaaagagcattgtaccaggaagtgggaacctatgtttccgaagccacatcaacattaaacaaaaggtcaaccccagaaatagcagcaaggcctaaagtgagtggactaggaagtagaatggaattctcttggaccctcttggatatgtgggacaccataagttttgagagcactggtaatctagttgcaccagagtatggattcaaaatatcgaagagaggtagttcagggatcatgaagacagaaggaacacttgagaactgtgagaccaaatgccaaactcctttgggag

SEQ ID NO: 110 - DNA, 1042 bp, Influenza A H3N2 (Fujian)
caaaaacttcccggaaatgacaacagcacggcaacgctgtgccttgggcaccatgcagtaccaaacggaacgattgtgaaaacaatcacgaatgaccaaattgaagttactaatgctactgagctggttcagagttcctcaacaggtggaatatgcgacagtcctcatcagatccttgatggagaaaactgcacactaatagatgctctattgggagaccctcagtgtgatggcttccaaaataagaaatgggacctttttgttgaacgcagcaaagcctacagcaactgttacccttatgatgtgccggattatgcctcccttaggtcactagttgcctcatccggcacactggagtttaacaatgaaagcttcaattggactggagtcactcagaatggaacaagctctgcttgcaaaaggagatctaataaaagtttctttagtagattgaattggttgacccatttaaaatacaaatacccagcattgaacgtgactatgccaaacaatgaaaaatttgacaaattgtacatttggggggttcaccacccgggtacggacagtgaccaaatcagcctatatgctcaagcatcaggaagaatcacagtctctaccaaaagaagccaacaaactgtaatcccgaatatcggatctagacccagggtaagggatgtctccagcagaataagcatctattggacaatagtaaaaccgggagacatacttttgattaacagcacagggaatctaattgctcctaggggttacttcaaaatacgaagtgggaaaagctcaataatgagatcagatgcacccattggcaaatgcaattctgaatgcatcactccaaatggaagcattcccaatgacaaaccatttcaaaatgtaaacaggatcacatatggggcctgtcccagatatgttaagcaaaacactctgaaattggcaacagggatgcgaaatgtaccagagaaacaaactagaggcatatttggcgcaatcgcgggtttcatagaaaatggttgggagggaatggtgg

SEQ ID NO: 111 - DNA, 1371 bp, Influenza A H4N6 (Swine: Ontario)
aggaaatcctgtgatatgcctggggcaccatgctgtgtccaatgggacaatggtgaaaaccttgacagatgaccaaatagaagttgtcactgcccaggaattagtggaatcgcaacatctaccggaattgtgtcctagccctctaagattagtagacgggcaaacttgcgatatcgtcaatggtgctctgggaagccctggctgtgatcacctgaatggtgcggagtgggatgtcttcatagagcgacccaccgctgtggacacttgttacccatttgatgtgccagattatcagagcctacggagcatcttggcaaacaatggaaaatttgagttcattgctgaggaattccaatggaacacagtcaaacaaaatgggaaatccggggcatgcaaaagagcaaatgtgaatgacttcttcaacagactgaattggctgaccaaatctgatggaaatgcatacccactccagaatttgacaaaagtcaacaacggggactacgcaagactttacatatggggggttcaccatccttcaaccgacacagaacaaaccaacctatataaaaacaaccccggaagagtgactgtttctacccaaaccagtcaaacaagtgtagtaccaaacattggcagtagaccatgggtgagaggcctaagcagcaggatcagcttctactggacaattgtggaaccaggagatctcatcgtcttcaacaccatagggaatctaattgctccgagaggtcattacaaactcaacagccaaaagaagagtacaattctaaatactgcagttcccataggatcttgcgttagtaagtgccacactgacaagggttcaatctctacaactaaaccctttcagaacatctcgagaatatcaattggggattgtcccaaatatgtcaaacagggatctttgaaacttgctacgggaatgaggaacatccctgagaaggcaaccagaggactatttggtgcaattgctgggttcatagagaatggctggcaaggtctgattgatggttggtacggatttaggcaccaaaatgcagaaggaacagggacagctgcagatctcaagtcgacccaggcagccattgatcaaattaatggaaagttaaatcgcctcattgagaagccaaatgagaaataccaccagatcgaaaaggaattcgaacaagtagaggggagaattcaggacttagagaagtatgttgaagacacgaagattgatctgtggtcttacaatgctgaactgttggtagcattagaaaatcaacataccatagacgtgacagattccgaaatgaacaaactctttgaaagagttagacaccagctacgagagaatgctgaggacaaagg

SEQ ID NO: 112 - DNA, 303 bp, Influenza A H5N1 (Vietnam)
atgccccaaatatgtgaaatcaaacagattagtccttgcgactgggctcagaaatagccctcaaagagagagaagaagaaaaaagagaggattatttggagctatagcaggttttatagagggaggatggcagggaatggtagatggttggtatgggtaccaccatagcaacgagcaggggagtgggtacgctgcagacaaagaatccactcaaaaggcaatagatggagtcaccaataaggtcaactcgattattgacaaaatgaacactcagtttgaggccgttggaagggaatttaacaa

SEQ ID NO: 113 - DNA, 887 bp, Influenza A H6N2 (Turkey; Germany)
ccgtcacacactcagttgaattgctggagaatcagaaagaagaaagattctgcaagatcttgaacaaggcccctctcgacctaaggggatgtaccatagaaggttggatcttagggaatcctcagtgcgacttattgcttggtgatcaaagctggtcatatatagtagaaaggcctactgctcaaaatgggatttgctacccaggaattttgaatgaagtagaagaactgagggcacttattggatcaggagaaagggtagaaagatttgagatgtttcccaaaagtacatgggctggagtagacaccagcagtggggtaacaaaagcttgcccttataacagtgggtcatctttctacagaaacctcctgtggataataaaaaccaagtcagcagcatatccagtaattaagggaacttacaacaacactggaaatcagccaatcctttacttctggggtgtgcaccatcctcctgacacaaatgagcaaaatactctgtacggttctggtgatcgatacgttaggatggggactgaaagcatgaactttgccaagagtccgaaaattgcagcaagacctgcggtgaacggtcaaagaggcagaattgattattactggtctgttttaaaaccaggggaaaccttggatgtggaatctaatggaaatctaatcgccccttggtacgcatacagatttgtcagcacaaataataaaggagccgtcttcaagtcaaatttaccaatagagaattgcgatgccacatgccagactattgcaggagtcctaaggaccaataaaacatttcagaatgtgagccctctgtggataggagaatgccccaaatatgtgaaaagtgaaagcctgaggcttgcaactggactaaga

SEQ ID NO: 114 - DNA, 818 bp, Influenza A H7N7 (Netherlands)
aaatcctggtattcgctctggtggcgagcattccgacaaatgcagacaagatctgccttgggcatcatgccgtgtcaaacgggactaaagtaaacacattaactgagagaggagtggaagtcgttaatgcaactgaaacggtggaacgaacaaacgttcccaggatctgctcaaaagggaaaaggacagttgacctcggtcaatgtggacttctgggaacaatcactgggccaccccaatgtgaccaattcctagaattttcggccgacttaattattgagaggcgagaaggaagtgatgtctgttatcctgggaaattcgtgaatgaagaagctctgaggcaaattctcagagagtcaggcggaattgacaaggagacaatgggattcacctacagcggaataagaactaatggaacaaccagtgcatgtaggagatcaggatcttcattctatgcagagatgaaatggctcctgtcaaacacagacaatgctgctttcccgcaaatgactaagtcatacaagaacacaaggaaagacccagctctgataatatgggggatccaccattccggatcaactacagaacagaccaagctatatgggagtggaaacaaactgataacagttgggagttctaattaccaacagtcctttgtaccgagtccaggagcgagaccacaagtgaatggccaatctggaagaattgactttcattggctgatactaaaccctaatgacacggtcactttcagtttcaatggggccttcatagctccagaccgtgcaagctttctgagagggaagtccatgggaatt

SEQ ID NO: 115 - DNA, 897 bp, Influenza A H8N4 (Duck; Alberta)
ctcttggcgagcacaaatgcatacgataggatatgcattggttaccaatcgaataactccacagacacagtgaacactctcatagaacagaatgtgccagtcactcaaacaatggagctcgtggaaacagagaagcattccgcttattgtaacactgatttaggtgccccattggaactgcgagactgcaaaatcgaggcagtaatctatggaaaccctaaatgtgacatccatctaaaggatcaaggttggtcatacatagtggagaggcccagcgcaccagaggggatgtgttaccctggatctgtagaaaatctggaagacctgaggtttgttttctccagtgcggcatcttataagagaataagactatttgactattccaggtggaatgtgactagctctggaacaagcaaagcatgcaatgcatcaacaggtggtcaatccttctataggagcatcaactggttgaccaaaaagaaaccagacacttatgatttcaatgaagggacttatgttaacaatgaagatggagacatcattttcttatgggggatccatcatccgcctgacacaaaagaacaaacgacactatataagaatgcaaacactttgagtagtgttactaccaacactataaacagaagctttcaacccaatattggccccagaccattagtaagaggacagcaaggaagaatggattactattggggcattctaaaaagaggagagactctgaaaatcagaaccaatgggaatttaatcgcacctgaatttggatatctactcaagggtgaaagccatggcagaataatccaaaatgaggatatacccatcgggaactgcaacacaaaatgtcaaacatatgcaggagcaatcaatagcagcaaaccc

SEQ ID NO: 116 - DNA, 601 bp, Influenza A H9N2 (Swine: China)
actccacagaaactgtagacacgccaacagaaaacaatgttcctgtgacacacgccaaagaattactccacacagagcacaatggaatgctgtgtgcaacaaatctgggacgtcccctcattctggacacctgtaccattgaagggctgatctatggcaacccttcctgtgatctactattgggaggaagagaatggtcctacatcgttgaaagaccatcggccgttaatggaatgtgttaccccgggaatgtagaaaacctagaggaactaaggtcactttttagctctgctagttcgtaccaaagaatccagatctttccagacacaatctggaatgtgtcttacagtggaacaagcaaagcatgttcggattcattctacaggagcatgagatggttgactcaaaagaacaatgcttaccctatccaagacgcccaatacacaaataatagaggaaagagcattcttttcatgtggggcataaatcacccacccaccgatactgcacagacaaatctgtacacaaggactgacacaacaacaagtgtggcaacagaagatataaataggaccttcaaaccattaatagggccaaggcc

SEQ ID NO: 117 - DNA, 775 bp, Influenza A H10 (Shorebird)
cctggagcgtccgtaaatgaagaagctctgaggcagaaaataatggagagcggagggatcagcaaaataagcactggtgtcacttatggatcttccatcaattcggctggaaccactaaagcatgcatgagaaatggaggaaatagcttttatgcagagctcaagtggctagtatcaaaaagtaaaggacaaaacttccctcagaccacgaacacttatagaaatacggacacagctgaacatctcataatatggggaatccatcacccttctagcactcaagagaagaatgatctatatgggacacaatcattgtctatatcagttgggagttccacttaccagaacaactttgttccggttgttggggcaaggcctcaggtcaatggacaaagtggaagaatcgattttcactggacactagtacaaccaggcgataacatcaccttcttacacaatgggggtctgatagcaccgagccgggttagcaaattgattggaaggggattggggattcaatcagacgcaccaatagacaatgattgtaagtctaaatgtttttggagaggaggttctataaatacaaagctccctttccaaaatttgtcaccaagaacagtgggccaatgtcctaaatatgtgaacaaaaagagtttgatgcttgcaacaggaatgagaaatgtgccagaaataatgcacgggagaggtctatttggtgcaatagcaggatttatagagaatggatgggaagggatggtcgatggatggtatggtt

SEQ ID NO: 118 - DNA, 728 bp, Influenza A H11 (Duck; Taiwan)
ctgcattcaggcagacgaaatctgcattgggtacctgagcaacaattcaacagagaaagtggacacaataattgagagtaatgtcacggttactagctcagttgaactggttgaaaatgagcacactggatctttctgctcaatcgacgggaaagtgccgataagtcttggtgattgctcctttgctggatggatccttgggaacccgatgtgtgatgatttgattggaaaaacatcatggtcttacatagtagagaaaccgaaccccgttaatggaatatgctatccgggtactctagaaaatgaggaagaattgagactgaagtttagtggggttctcgaattcagcaaatttgaagccttcacctcaaacggatggggagcagtgaattccggtgctggtgttaccgcagcctgcaaatttggaagcagtaactcttttttcagaaacatggtatggttgatacatcaatcagggacataccctgtcatacggaggacattcaacaacaccaaaggaggagatgtattaatggtatggggagttcaccatcctgcaactctaaaggaacaccaagatttgtacaaaaaagacagttcttatgtagcagtgggttcagagagttataacaggaggttcacccctgagattagcacaagacctagagtaaatggtcaggctgggagaatgaccttctactggaccatagtgaaacctggagaggcaa

SEQ ID NO: 119 - DNA, 738 bp, Influenza A H12N4 (Ruddy Turnstone; Delaware)
cactgttctggcagtaagctttgcgtatgacaaaatctgcattggatatcaaacaaacaactcgacagaaacggtaaacacactaattgaacaaaacgttccggtgacacaagtggaagaactcgtgcatggcgggattgatccgatcctatgtggaacggaattaggatcaccactagtgcttgatgactgttcattagagggtctaattctgggcaatcccaaatgtgatctctatttgaatggcagagaatggtcatacatagtagagaggccaaaagagatggaaggaatttgctacccaggatcaattgaaaaccaggaagagctaagatctctgttttcttccatcaaaaagtatgaaagggtgaagatgtttgatttcaccaaatggaatgtcacatacactggaaccagcaaggcctgcaatgatacatcaaaccaaggctcattctataggagcatgagatggttgaccttaaaatcaggccaattcccagtccaggcagatgagtacaagaacaccagagattcagccattgtattcatgtgggcaattcaccacccaccaacattttatgaacaagtaaaattgtacaaaaatcctgataccctctcctcagtcaccaccgatgagatcaataggagcttcaagcctaatattgggccaaggccgctcgtaaggggacaacaggggagaatggattactactgggctgttcttaaacctggccaaac

SEQ ID NO: 120 - DNA, 1765 bp, Influenza A H13N6 (Gull; Astrakan)
agcaaaagcagggaaaatttcaacaaactgacacaagagaaatggacatccaagcagtcgcactcttgatattaaccagcacatgcgtacaggctgatagaatctgtgtgggatacttaagcaccaactcatcagaaaaagttaacacactgttagagaacgatgtcccggttacaagttctgtcgatctggttgagactagccacacaggaacatattgttctttggatggaatcagtccagtgcatttgggagactgtagcttcgagggttggattgtagggaaccctgcctgtgccagcaacatggggatcagagaatggtcatacttgattgaagatccctctgcacctcatggactgtgctacccaggagagttagacaacaatggagaattgaggcacctgttcagtggaatcagatctttcagtagaacagagttgatcgcacctacttcttggggggcagtgaatgatggagtatcatcggcctgccaggatcgaggggccagcagcttttatcgaaatttggtatggtttgtggagagaggcaagcaatatccagtgatccgcgggacctacaacaatacaactggcagagatgttttggtcatgtgggggatacatcatcctgtttccacagacgaggcgagaaaactatatgtcaacaatgacccatatacattggtatctaccagttcatggagtagaaaatacaacttagaaattggaatccggcctggatacaatggccaaaagagttggatgaagatttactggtatttgatgcacccaggggaatcaatcagtttcgaaagcaatggaggattgttggcccccagatatggttatattattgaggaatatggaaaagggcgaattttccaaagtcgcattcgcattgctaaatgcaatactaagtgtcagacatctgttggtgggataaataccaacaaaacatttcaaaacatagagagaaatgcacttggggattgcccaaaatacataaaatctgggcagctcaagttggccaccggacttagaaatgtacctgccatatcaaacagaggattatttggagctattgcaggcttcatagaaggtggttggccaggattaataaatggttggtatggattccaacatcagaacgaacaaggagtgggaatggctgcagacaaagagtcaacacaaaaggctattgatcaaataacaaccaagataaacaatatcattgaaaaaatgaatggaaattatgactccatacgaggtgaattcaatcaagtggaacaaaggataaatatgcttgcagacagaatagatgacgctgtaactgatgtatggtcatacaatgcaaagcttcttgtgttgctagagaacgataaaactctagacatgcatgatgccaatgttagaaacctgcatgaccaagtacgtagagcactaaagaccaatgcaattgatgaggggaatggatgctttgaactcctccataaatgcaatgactcttgcatggagacaataagaaatgggacgtacaatcacacagaatatgaagaagaatcaaaattgaagagacaggaaatagaaggtataaagctgaagtcagacgataatgtttacaaagcattatcgatttacagctgcattgcaagcagtattgtaatggtaggactcatacttgcattcatcatgtggacatgcaacagtggaaactgccggttcaatatctgtatataagtagaaaaaatacccttgtttctact

SEQ ID NO: 121 - DNA, 763 bp, Influenza A H14 (mallard; Gurjev)
cacaaatgggacaacaggaaaccccattatatgcttggggcatcatgcagtggaaaacggcacatctgttaaaacactaacagacaatcacgtagaagttgtgtcagctaaagaattagttgagacgaaccacactgatgaactgtgcccaagccccttgaagcttgtcgacgggcaagactgccacctcatcaatggtgcattggggagtccaggctgtgaccgtttgcaggacaccacttgggatgtcttcattgaaaggcccactgcagtagacacatgttatccattcgacgtcccagattaccagagtctcagaagcatcctagcaagcagtgggagtttggagttcatcgccgaacaattcacctggaatggtgtcaaagttgacggatcaagcagtgcttgtttgaggggcggtcgcaacagcttcttctcccgactaaactggctaaccaaagcaacaaatggaaactatggacctattaacgtcactaaagaaaatacgggctcttatgtcaggctctatctctggggagtgcatcacccatcaagcgataatgagcaaacggatctctacaaggtggcaacagggagagtaacagtatctacccgctcggaccaaatcagtattgttcccaatataggaagtagaccgagggtaaggaatcagagcggcaggataagcatctactggaccctagtaaacccaggggactccatcattttcaacagtattgggaatttgattgcaccaagaggc

SEQ ID NO: 122 - DNA, 793 bp, Influenza A H15N8 (Duck; Australia)
acggagacagtggagattacaggaataaataaagtgtgcacaaaagggaagaaagcggtggacttgggatcttgtggaatactgggaactatcattgggcctccacaatgtgactctcatcttaaattcaaagctgatctgataatagaaagaagaaattcaagtgacatctgttacccagggaaattcactaatgaggaagcactgagacaaataatcagagaatctggtggaattgacaaagagccaatgggatttagatattcaggaataaaaacagacggggcaaccagtgcgtgtaagagaacagtgtcctctttctactcagaaatgaaatggcttttatccagcaaggctaaccaggtgttcccacaactgaatcagacatacaggaacaacagaaaagaaccagccctaattgtttggggagtacatcattcaagttccttggatgagcaaaataagctatatggagctgggaacaagctgataacagtaggaagctcaaaataccaacaatcgttttcaccaagtccaggggacaggcccaaagtgaatggtcaggccgggaggatcgactttcattggatgctattggacccaggggatacagtcacttttaccttcaatggtgcattcatagccccagatagagccacctttctccgctctaatgccccatcgggagttgagtacaatgggaagtcactgggaatacagagtgatgcacaaattgatgaatcatgtgaaggggaatgcttctacagtggagggacaataaacagccctttgc

SEQ ID NO: 123 - DNA, 1459 bp, Influenza A H1N1 (New Caledonia Like)
caaaagcaggagtttaaaatgaatccaaatcaaaaaataataaccattggatcaatcagtatagcaatcggaataattagtctaatgttgcaaataggaaatattatttcaatatgggctagtcactcaatccaaactggaagtcaaaaccacactggagtatgcaaccaaagaatcatcacatatgaaaacagcacctgggtgaatcacacatatgttaatattaacaacactaatgttgttgctggaaaggacaaaacttcagtgacattggccggcaattcatctctttgttctatcagtggatgggctatatacacaaaagacaacagcataagaattggctccaaaggagatgtttttgtcataagagaacctttcatatcatgttctcacttggaatgcagaaccttttttctgacccaaggtgctctattaaatgacaaacattcaaatgggaccgttaaggacagaagtccttatagggccttaatgagctgtcctctaggtgaagctccgtccccatacaattcaaagtttgaatcagttgcatggtcagcaagcgcatgccatgatggcatgggctggttaacaatcggaatttctggtccagacaatggagctgtggctgtactaaaatacaacggcataataactgaaaccataaaaagttggaaaaagcgaatattaagaacacaagagtctgaatgtgtctgtgtgaacgggtcatgtttcaccataatgaccgatggcccgagtaatggggccgcctcgtacaaaatcttcaagatcgaaaaggggaaggttactaaatcaatagagttgaatgcacccaattttcattatgaggaatgttcctgttacccagacactggcacagtgatgtgtgtatgcagggacaactggcatggttcaaatcgaccttgggtgtcttttaatcaaaacctggattatcaaataggatacatctgcagtggggtgttcggtgacaatccgcgtcccaaagatggagagggcagctgtaatccagtgactgttgatggagcagacggagtaaaggggttttcatacaaatatggtaatggtgtttggataggaaggactaaaagtaacagacttagaaaggggtttgagatgatttgggatcctaatggatggacagataccgacagtgatttctcagtgaaacaggatgttgtggcaataactgattggtcagggtacagcggaagtttcgttcaacatcctgagttaacaggattggactgtataagaccttgcttctgggttgagttagtcagaggactgcctagagaaaatacaacaatctggactagtgggagcagcatttctttttgtggcgtaaatagtgatactgcaaactggtcttggccagacggtgctgagttgccgttcaccattgacaagtagttcgttgaaaaaactccttgtttctact

SEQ ID NO: 124 - DNA, 575 bp, Influenza A H5N1 (Vietnam)
tgccatgatggcaccagttggttgacaattggaatttctggcccagacaatggggcggtggctgtattgaaatacaatggcataataacagacactatcaagagttggaggaacaacatactgagaactcaagagtctgaatgtgcatgtgtaaatggttcttgctttactgtaatgactgacggaccaagtaatggtcaggcatcacataagatcttcaaaatggaaaaagggaaagtggttaaatcagtcgaattggatgctcctaattatcactatgaggaatgctcctgttatcctgatgccggcgaaatcacatgtgtgtgcagggataattggcatggttcaaatcggccatgggtatctttcaatcaaaatttggagtatcaaataggatatatatgcagtggagttttcggagacaatccacgccccaatgatggaacaggtagttgtggtccggtgtcctctaacggggcaggtggggtaaaagggttttcatttaaatacggcaatggtgtctggatcgggagaaccaaaagcactaattccaggagcggcttcgaaatgatttg

SEQ ID NO: 125 - DNA, 1062 bp, Influenza A H3N2 (Ireland)
tcatgcgatcctgacaagtgttatcaatttgcccttgggcagggaacatcactaaacagcgggcattcaaatgacacagtacatgataggaccccttaccggaccctattgatgaatgaattgggtgttccatttcacttgggaaccaggcaagtgtgcatagcatggtccagctcaagttgtcacgatggaaaagcatggctgcatgtttgtgtaactggggatgatgaaaatgcaactgctagcttcatttacaatgggaggcttgtagatagtattggttcatggtccaaaaaaatactcagaacccaggagtcggaatgcgtttgtatcaatggaacttgtacagtagtaatgactgatgggagcgcttcaggaaaagctgatactaaaatactattcattgaggaggggaaaatcgttcatattagcacattgtcaggaagtgctcagcatgtcgaggagtgctcctgttatcctcgatatcctggtgtcagatgtgtctgcagagacaactggaaaggctccaataggcccatcgtagatataaatgtaaaggattatagcattgtttccagttatgtgtgctcaggacttgttggagacacacccagaaaaaacgacagcttcagcagtagccattgcctagatcctaacaatgaggaaggtggtcatggagtgaaaggctgggcctttgatgatggaaatgacgtgtggatgggaagaacgatcagcgagaagttacgctcaggttatgaaaccttcaaagtcatcgaaggctggtccaaacctaactccaaattacagataaataggcaagtcatagttgaaagaggtaacaggtccggttattctggtattttctccgttgaaggcaaaagctgcatcaatcggtgcttttatgtggagttgataaggggaaggaaagaggaaactgaagtctggtggacctcaaacagtattgttgtgttttgtggcacctcaggtacatatggaacaggctcatggcctgatggggcggatatcaatctcatgcctatataagctttcgcaattttagaa

SEQ ID NO: 126 - DNA, 852 bp, Influenza A H5N3 (chicken: TX)
gccctttcagaggattcttcccttttcacaaagacaatgcaatacggctgggtgagaacaaagacgtcatagttacaagggagccttatgttagctgcgataatgacaattgctggtcctttgccctcgcacagggagcactgctagggactaaacatagcaatggaaccattaaagacagaacaccgtacagatctctaatccgattcccaataggaacagctccagtattgggaaattacaaggagatttgcattgcttggtcgagcagcagttgctttgatggaaaagagtggatgcacgtatgcatgacagggaacgataatgatgcaagtgcccagataatatatgcagggaaaatgacagactccattaaatcatggagaaaggacatactgagaactcaggagtccgaatgtcaatgcattggagggacatgtgttgttgctgtaacagatggccctgctgctaatagtgcagatcacaggatttactggatacgagagggaagaataatgaagtatgaaaatgtccccaaaacaaagatacaacatctagaagagtgttcctgctatgtggacattgatgtttactgtatatgtagggacaattggaagggttctaacagaccttggatgagaatcaacaacgagactatattggaaacagggtatgtttgcagtaaattccattcagatacccccaggccagctgacccctcaacaatgtcatgtgactccccaagtaacgttaatggaagacccggagtgaagggatttggtttcaaagctggcaatgatgtatggttgggtagaactgtgtcacctagtggtagatcgggctttgaagtca

SEQ ID NO: 127 - DNA, 257 bp, Influenza A H8N4 (Duck: Alberta)
agcaaaagcaggagtttcattatgaatccaaatcagaaaatcataaccatcggcagtgctagtattatattaacaacaataggcctgctcctcaaaataacaagtttatgctcaatatggtttagccattacaaccaagtgacacaaacgcatgaacaaccctgtccacgaacacaacaaattactacaactgaaacctttgttaatgtaccgaatgtgcaaaacaactataccacacgtattgaccctcagccccc

SEQ ID NO: 128 - DNA, 913 bp, Influenza A H6N5 (Shearwater)
cggtgagagtggaaacagtggtaatccctgtcaacaacaccatatatttgaatcatgagccagaattcctcaacaacacggaacctctctgtgatgtatcgggatttgccattgtttccaaggataatgggatcagaataggttcaagagggcacatatttgttataagagagccctttgtatcttgtggcccttcagaatgtaggacctttttcttaacgcagggtgccttgctgaatgacaagcattcaaataacacagtaaaagacaggagtccctatcgggcattgatgagtgtaccattgggatcctctcctaatgcctaccaagccaaattcgagtccgtaggatggtctgcaacagcctgccatgatgggaaaaaatggatggccataggggtgagtggtgcagacgatgacgcttatgctgttattcattatgggggagtgccgacagatgtgataaggtcatggaggaagcaaatactaagaacacaagagtcttcgtgtgtttgcataaagggagagtgttattgggtaatgacggacggtccagcgaataatcaagcaagttacaaaatcttcaaatctcagaagggtatggtagttgatgaaaaagaaatttcattccaaggtgggcacattgaagaatgttcctgttatcccaacatggggaaagtggagtgtgtttgcagggacaattggaacggaatgaatagaccaattctgatattcgatgaaaagcttgagtatgaagtcggttatctatgcgctggaattccaacagacaccccaagagttcaagacagcagcttcactggctcatgcaccaatgcagttgggaggagtgggacaaacaattatggagtaaagggattcggctttagacaaggaaatagtgtatgggcgggaag

SEQ ID NO: 129 - DNA, 739 bp, Influenza A H4N6 (Swine: Ontario)
agaggatgcccacatacttgtcacaagagaaccatatctctcgtgtggaccacacgagtgcagaatgtttgccctcagccaaggtaccacactaaggggtcggcatgcaaatgggactatacatgacagaagcccgtttagggcattaataagttgggaaatggggcaagcaccgagcccatacaatatcagagtagaatgtgtgggatggtccagcacctcatgccatgacggcatctcaagaatgtcaatctgcatgtcaggacctaataacaatgcttcggcagtggtctggtacaagggaaggccagtcaccgaaattgcttcgtgggcaggaaatatattaaggactcaggaatcagaatgtgtatgccataatggaatatgtcctgtggtgatgacggatggcccagctaataacagagcagaaacaaaaataatttatttcaaagagggaaaaatacagaaaatagaagaattgacaggaagtgcacagcatatagaagagtgctcatgctatggagcagaagaaatgattaaatgcatttgcagggacaattggaagggtgcaaatagaccagtaatcaccataaacccaaaaacgatgactcatacgagcaaatacttgtgttcaaagatcctaactgacacaagccgacctaatgaccccggaagcggaaactgtgatgcaccgataaccggagggggcccagatcctggcgtaaagggatttgcattc

SEQ ID NO: 130 - DNA, 994 bp, Influenza A H7N7 (Netherlands)
agcagggtgatcgagaatgaatccaaatcagaaactatttgcattatctggagtggcaatagcacttagtgtactgaacttattgataggaatctcaaacgtcggattgaacgtatctctacatctaaaggaaaaaggacccaaacaggaggagaatttaacatgcacgaccattaatcaaaacaacactactgtagtagaaaacacatatgtaaataatacaacaataattaccaagggaactgatttgaaaacaccaagctatctgctgttgaacaagagcctgtgcaatgttgaagggtgggtcgtgatagcaaaagacaatgcagtaagatttggggaaagtgaacaaatcattgttaccagggagccatatgtatcatgcgacccaacaggatgcaaaatgtatgccttgcaccaagggactaccattaggaacaaacattcaaatggaacgattcatgacagaacagctttcagaggtctcatctccactccattgggcactccaccaaccgtaagtaacagtgactttatgtgtgttggatggtcaagcacaacttgccatgatgggattgctaggatgactatctgtatacaaggaaataatgacaatgctacagcaacggtttattacaacagaaggctgaccactaccattaagacctgggccagaaacattctgaggactcaagaatcagaatgtgtgtgccacaatggcacatgtgcagttgtaatgaccgacggatcggctagtagtcaagcctatacaaaagtaatgtatttccacaagggattagtagttaaggaggaggagttaaggggatcagccagacatattgaggaatgctcctgttatggacacaatcaaaaggtgacctgtgtgtgcagagataactggcagggagcaaacaggcctattatagaaattgatatgagcacattggagcacacaagtagatacgtgtgcactggaattctcacagacaccagc

SEQ ID NO: 131 - DNA, 843 bp, Influenza A H5N8 (Duck: NY)
caatacagagccattgtgtgacgctaagggttttgcacccttttccaaagacaatggaataagaattggatcgagaggccatgtttttgttataagggaaccatttgtttcttgctcgccatcagaatgcagaacgttctttcttactcaaggttctctactcaatgacaaacattctaatggcacagtgaaagaccggagcccctacagaactctaatgagtgtagaaatagggcaatcacccaatgtgtaccaagcaaggtttgaagcggtagcatggtcagccactgcatgtcatgatgggaaaaaatggacgacaattggagtaacgggccctgattccaaagcagtggcagtggtgcattatgggggaattcccactgatgtaatcaactcctgggcaggagatattctaagaacccaggaatcatcatgcacctgcattcgaggtgagtgctattgggttatgacggatggaccggcaaacagacaagcgcaatacaaagcattcaaagccaagcagggaaaaataattgggcaaactgaaatcagtttcaatggaggccatatagaagaatgctcatgctaccccaatgaaggtaaagtagaatgtgtttgtagagacaactggactggaaccaacaggccagtattggttatctctccagatttgtcctacagagtcggatacttatgtgcaggtctccctagcgacaccccaagaggagaagatagtcagttcacggggtcatgcactagtcccatgggaaaccaggggtatggagttaagggatttggattcaggcagggcaatgatgtatggatgggaaggaccattagcag

SEQ ID NO: 132 - DNA, 444 bp, Influenza A H2N9 (Duck: Nanchang)
aacctgaagcaaccaatgcaagccaaacaataataaacaactattataatgaaacaaacatcacccaaataagtaacaccaacatccaaatggaagagagagcaagcaggggtttcaataacttaactaaagggctctgtactataaattcatggcacatatatgggaaagacaatgcagtaagaattggagagaactcagatgttttagtcacaagagaaccctatgtttcatgcgacccagatgaatgcaggttctatgctctaagccaagggacaacaatcagagggaaacactcaaacggaacaatacacgataggtcccagtatcgcgccctaataagctggccactatcatcaccacccacagtatacaacagcaaggtagaatgcattgggtggtcaagtactagttgccatgatggtaagtccaggatgtcaatat

SEQ ID NO: 133 - DNA, 734 bp, Influenza A H1N1 (New Caledonia Like)
atggaatggctaaagacaagaccaatcctgtcacctctgactaaggggattttaggatttgtgttcacgctcaccgtgcccagtgagcgaggactgcagcgtagacgctttgtccaaaatgcccttaatgggaatggggatccaaataatatggacagagcagttaaactgtatcgaaagcttaagagggagataacattccatggggccaaagaaatagcactcagttattctgctggtgcacttgccagttgtatgggactcatatacaacaggatgggggctgtgaccaccgaatcagcatttggccttatatgcgcaacctgtgaacagattgccgactcccagcataagtctcataggcaaatggtaacaacaaccaacccattaataagacatgagaacagaatggttctggccagcactacagctaaggctatggagcaaatggctggatcgagtgaacaagcagctgaggccatggaggttgctagtcaggccaggcagatggtgcaggcaatgagagccattgggactcatcctagctctagcactggtctgaaaaatgatctccttgaaaatttgcaggcctatcagaaacgaatgggggtgcagatgcaacgattcaagtgatcctcttgttgttgccgcaagtataattgggattgtgcacctgatattgtggattattgatcgccttttttccaaaagcatttatcgtatctttaaacacg

SEQ ID NO: 134 - DNA, 657 bp, Influenza A H5N1 (Vietnam)
agaccaatcctgtcacctctgactaaagggattttgggatttgtattcacgctcaccgtgcccagtgagcgaggactgcagcgtagacgctttgtccagaatgccctaaatggaaatggagatccaaataatatggatagggcagttaagctatataagaagctgaaaagagaaataacattccatggggctaaggaggtcgcactcagctactcaaccggtgcacttgccagttgcatgggtctcatatacaacaggatgggaacggtgaccacggaagtggcttttggcctagtgtgtgccacttgtgagcagattgcagattcacagcatcggtctcacagacagatggcaactatcaccaacccactaatcagacatgagaacagaatggtgctggccagcactacagctaaggctatggagcagatggcgggatcaagtgagcaggcagcggaagccatggagatcgctaatcaggctaggcagatggtgcaggcaatgaggacaattgggactcatcctaactctagtgctggtctgagagataatcttcttgaaaatttgcaggcctaccagaaacgaatgggagtgcagatgcagcgattcaagtgatcctattgttgttgccgcaaatatcattgggatcttgcactt

SEQ ID NO: 135 - DNA, 780 bp, Influenza B
gggaagtcaatgtgactggtgtgataccactgacaacaacacccaccaaatctcattttgcaaatctcaaaggaacaaaaaccagagggaaactatgcccaaaatgtctcaactgcacagatctggacgtggccttgggcagaccaaaatgcacagggaacataccttcggcaaaagtttcaatactccatgaagtaagacctgttacatctgggtgctttcctataatgcacgacagaacaaaaattagacagctgcccaatcttctcagaggatacgaacgtatcaggttatcaaaccataacgttatcaatgcagaaaaagcaccaggaggaccctacaaaattggaacctcagggtcttgccctaacgttaccaatggaaacggattcttcgcaacaatggcttgggctgtcccaaaaaacgaaaacaacaaaacagcaacaaattcattaacaatagaagtgccatacatttgtacagaaggagaagaccaaattaccgtttgggggttccactctgataacgaaacccaaatggcaaaactctatggagattcaaagcctcagaaattcacttcatctgccaacggagtgaccacacattacgtttcacagattggtggcttcccaaatcaaacagaagacggaggactaccacaaagtggtagaattgttgttgattacatggtgcaaaaatctggaaaaacaggaacaattacctatcaaagaggtattttattgcctcaaaaagtgtggtgtgcaagtggcaggagcaagg

SEQ ID NO: 136 - DNA, 809 bp, Influenza B
gccctcatagattcggagaaaccaaaggaaactcagctcccttgataataagggaaccttttattgcttgtggaccaaaggaatgcaaacactttgctctaacccattatgcagcccaaccagggggatactacaatggaacaagaggagacagaaacaagctgaggcatctaatttcagtcaaattgggcaaaatcccaacagtagaaaactccattttccacatggcagcatggagcgggtccgcatgccatgatggtaaggaatggacatatatcggagttgatggccctgacaataatgcattgctcaaaataaaatatggagaagcatatactgacacataccattcctatgcaaacaacatcctaagaacacaagaaagtgcctgcaattgcatcgggggaaattgttatcttatgataactgatggctcagcttcaggtgttagtgaatgcagatttcttaagattcgagagggccgaataataaaagaaatatttccaacaggaagagtaaaacatactgaagaatgcacatgcggatttgccagcaataaaaccatagaatgtgcctgtagagataacagttacacagcaaaaagaccctttgtcaaattaaacgtggagactgatacagcagaaataagattgatgtgcacagagacttatttggacacccccagaccagatgatggaagcataacagggccttgtgaatctaatggggacaaagggagtggaggcatcaagggaggatttgttcatcaaagaatggcatccaagattggaaggtggtactctcgaacg

SEQ ID NO: 137 - DNA, 763 bp, Influenza B
ggagaaggcaaagcagaactagcagaaaaattacactgttggttcggtgggaaagaatttgacctagactctgccttggaatggataaaaaacaaaagatgcttaactgatatacaaaaagcactaattggtgcctctatatgctttttaaaacccaaagaccaggaaaggaaaagaagattcatcacagagcctctatcaggaatgggaacaacagcaacaaaaaagaaaggcctgattctagctgagagaaaaatgagaagatgtgtgagctttcatgaagcatttgaaatagcagaaggccatgaaagctcagcgctactgtattgtctcatggtcatgtacctgaatcctggaaattattcaatgcaagtaaaactaggaacgctctgtgctttgtgcgagaaacaagcatcacattcacacagggctcatagcagagcagcgagatcttcagtgcccggagtgagacgagaaatgcagatggtctcagctatgaacacagcaaaaacaatgaatggaatgggaaaaggagaagacgtccaaaagctggcagaagagctgcaaagcaacattggagtgttgagatctctcggagcaagtcaaaagaatggggaaggaattgcaaaggatgtaatggaagtgctaaagcagagctctatgggaaattcagctcttgtgaagaaatatctataatgctcgaaccatttcagattctttcaatttgttcttttatcttatcagctctccacttcatggcttg

SEQ ID NO: 138 - DNA, 401 bp, Influenza C
cttcttgctatttcatttatgatagtaaagaagtgtataataaaagaggatgtggcaactactttcaagtgatctatgattcatctggaaaagttgttggaggactagataacagggtatcaccttacacagggaattctggagacactccaacaatgcaatgtgacatgctccagctgaaacctggaagatattcagtaagaagctctccaagattccttttaatgcctgaaagaagttattgctttgacatgaaagaaaaaggaccagtcactgctgtccaatccatttggggaaaaggcagaaaatctgactatgcagtggatcaagcttgcttgagcactccagggtgcatgttaatccaaaagcaaaagccatacgttggagaagctgatgatcat

SEQ ID NO: 139 - DNA, 862 bp, Influenza C
atgtccgacaaaacagtcaaatcaacaaatttaatggcatttgtagccacaaaaatgttagagagacaagaagatttagacacatgcactgaaatgcaagtagaaaaaatgaaaacgtcaacaaaagccaggttgagaacagaatcttcctttgcacctagaacgtgggaagatgcaataaaagatggtgagcttctattcaacgggacgattctgcaagcagagtctcttacaatgacgccagcgtccgtagaaatgaagggaaagaaacctcctattgattttgctccaagcaacatagcaccaattgggcaaaatccaatttatttgtcaccatgtattcctagctttgatggaaacgtctgggaagcaacgatgtatcatcatcgtggagcaactttaacaaagacaatgaattgcaactgttttcaaagaacaatttggtgccatccaaacccttcacgtatgagattgagctatgcatttgttttgtattgcagaaatactaagaagatctgtggatacctcatcgctagacaagtggccggaattgaaacaggaattagaaaatgtttcagatgcattaaaagcggattcgttatggctaccgatgaaatctctctcactatactccgaagtatcaaatcaggagcccagctcgatccctattggggaaatgaaacaccagatattgacaagactgaagcttatatgctctcgcttagagaagctggaccataacctgagcaaagcagtcttgggaatccaaaattctgaagatcttattttgattatacataacagagatgtttgtaaaaacattatattaatgataaaatctttgtgcaattcacttatataa

SEQ ID NO: 140 - DNA, 1728 bp, Parainfluenza 1
atggctgaaaaagggaaaacaaatagttcatattggtctacaacccgaaatgacaattccacggtaaacacacacattaatacaccagcaggaaggacacacatctggctactgattgcaacaacaatgcatacagtattgtccttcattatcatgatcctatgcattgacctaattataaaacaagacacttgtatgaagacaaacatcatgacagtatcctccatgaacgaaagtgccaaaataatcaaagagacaatcacagaattaatcagacaagaagtaatatcaaggaccataaacatacaaagttcagtacaaagcgggatcccaatattgttaaacaagcaaagcagagatctcacacaattaatagagaagtcatgcaacagacaggaattggctcagatatgcgaaaacaccattgctattcaccatgcagacggcatatctcctctggacccacacgatttctggagatgtcccgtaggggaacccctactgagcaacaaccccaatatctcattattacctggaccaagtctactttctggatccaccacaatttcaggatgtgttagactaccttcattatcaattggtgatgcaatatatgcgtattcatcaaacttaatcactcaaggatgtgcagatatagggaagtcatatcaggttttacaattaggttacatatccttaaattcagatatgtatcctgatttaaacccggtaatttctcatacctatgacatcaacgacaacaggaaatcatgttctgtaatagctgcaggaacaaggggttatcagttatgctccttgcccactgtgaatgagactacagactactcgagtgaaggtatagaagatttagtatttgacatattagatctcaagggaaagaccaaatctcatcgatacaaaaatgaagatataacttttgaccatcctttttctgcaatgtatccgagtgtaggaagtgggataaaaattgaaaatacactcattttcctagggtacggtggcttaacaactccgctccaaggcgacactaagtgtgtgataaacagatgtaccaatgttaatcagagtgtttgcaatgatgctcttaagataacttggctaaagaaaagacaagttgtcaatgtcttaattcgtatcaataattatttatctgataggccaaagattgttgtcgagacaattccaataactcaaaattacttaggtgccgaaggtaggctacttaaactaggtaaaaagatctacatatatactagatcttcaggttggcactccaacctgcaaataggatcattagatatcaacaaccccatgaccattaaatgggcgcctcatgaagtcctgtctcgaccaggaaaccaagactgcaactggtacaacagatgtccgagagaatgcatatcaggtgtatatactgatgcatatccactatctcctgatgcagtcaatgttgctacaaccacactgtacgcaaacacatcacgtgttaatcccaccataatgtactcaaatacctcagaaattatcaacatgctaagactcaagaatgtacaactagaggcagcatacactactacatcatgtatcactcatttcgggaagggctactgcttccacattgttgaaatcaaccaagccagccttaataccttacaacctatgttgttcaagacaagtatccctaaaatatgtaaaatcacatcttga

SEQ ID NO: 141 - DNA, 958 bp, Parainfluenza 1
ccggagaaaggaaatggctgaaacatacaggttccccagattctcacacgaagaaaatgggacagtagaacctctccctctcaaaacaggtcctgacaaaaaagcaatccctcacatcagaatagtcaaggtaggagatcctccaaaacatggagtcaggtatcttgatgtgctactattgggattctttgaaacacctaagcaaggacctctatctggcagcatatctgatctcacagaatcaaccagttattcaatctgtggatccggatccttaccaattggcatagccaagtattacggcacagatcaagaattattaaaagcctgcattgacctcaaaataactgtacgaagaacagttagatctggagaaatgatagtatacatggtagattcgatccatgctcctctactaccatggtccagccgactgagacaagggatgatatataatgccaataaagtagctctagcacctcaatgtctcccagtcgacaaagacatcagattcagggttgtatttgtcaatggaacatcactaggtacaattacaattgctaaggtcccaaaaactcttgcagatcttgcattaccgaactcaatatcagtgaatctgctggttacacttagggcaggagtatcaacggaacaaaaaggaatcctccccgttctagacgatgatggagaaaagaagctcaacttcatggtacacctaggaatcataagaagaaaagttgggaagatatattcagttgaatactgcaaaaataaaattgagaagatgaagctaatattctctctcgggcttgtaggtggaataagtttccatgtacatgcaacaggcacattatccaaaactctaatgagccaacttgcatggaaaaaagcagtttgctatcctttaatggatgtaaatccacatatgaatctagtcatctgggcagcttcagtagaa

SEQ ID NO: 142 - DNA, 1682 bp, Parainfluenza 1
agggttaaagtaatactttaaagggacaagtcacagacatttgatcttagtataaatttttataatggccgggctactaagtacttttgacacatttagttccaggagaagtgagagcatcaataagtctggcggaggagcaattatacctggtcaaagaagtaccgtttctgtcttcacattaggcccgagtgtgacagatgatgcagataaattattaatagcaaccactttcttagcccactcattggacacagataaacaacactctcaaagaggaggatttttagtatcactccttgcaatggcctacagtagtccggagttatatctcactacaaacggtgtcaatgctgatgtcaagtatgtgatatacaatatagagagagatcctaaaagaacaaaaacagatgggttcattgtcaaaacaagagacatggagtatgaaagaacaacagagtggttgtttggacctatgatcaacaagaacccattgttccaagggcaaagagagaatgcggatctagaggcattgcttcagacatatggatatcctgcatgtctcggagctataatagttcaagtttggatagtgttggttaaagccataacaagtagtgctggtctaagaaaaggattcttcaatagattagaagcattcagacaggatggaaccgttaaaagtgccctggtcttcacaggagacacagttgaaggtattggtgcagtgatgaggtcacaacaaagcttagtatctcttatggtagaaactctggtgactatgaacacatccaggtcagatttaactacattagagaagaacattcagattgtaggaaattacataagagatgcaggattagcatctttcatgaacaccatcaagtatggtgtagaaacgaagatggccgccctgacactatcaaatctgagaccagatataaacaaattgagaagccttgttgatatctatctatcaaagggagcccgagccccttttatatgtatactcagagacccagttcatggagactttgcccctggaaactatccagcactgtggagctacgcaatgggcgttgctgtggtacaaaacaaagctatgcaacagtatgtaactggaagaacatatttggacatggaaatgttcctacttggacaagctgtagctaaagatgctgattccaaaatcagcagtgctctggaggaagaactaggtgtgacagatacagcaaaagagagactaagacaccatctgacaaacctttcaggaggggatggtgcgtaccacaagcctacaggtggtggagctatagaagtggcaattgatcatacagacataacatttggagtcgaggacactgctgatcgggacaacaagaactggacaaatgacagcaatgaaagatggatgaatcactcgatcagcaaccacacaatcacgattcgtggtgcagaagaacttgaagaagagacaaatgatgaagacatcactgatatagaaaacaagattgcacgaaggctggccgacagaaaacagagactaagccaggcaaacaataaacgagacaccagcagtgatgctgactatgagaatgatgatgatgctacagcggctgcagggataggaggaatttaacaggatacttggacaatagaagccagatcaaaagtaagaaaaa

SEQ ID NO: 143 - DNA, 1716 bp, Parainfluenza 2
atggaagattacagcaatctatctcttaaatcaattcctaaaaggacatgtagaatcattttccgaactgccacaattcttggaatatgcacattgattgttctatgttcaagtattcttcatgagataattcatcttgatgtttcctctggtctcatggattccgatgattcacagcaaggcattattcagcctattatagaatcattaaaatcattaattgctttggctaaccagattctgtacaatgttgcaataataattcctcttaaaattgacagtatcgagactgtaatattctctgctttaaaggatatgcatactgggagcatgtccaacaccaactgtacacccggaaatctgcttctgcatgatgcagcgtacatcaatggaataaacaaattccttgtacttaaatcatacaatgggacgcctaaatatggacctctcctaaatattcccagctttatcccctcagcaacatctcccaacgggtgcactagaataccatcattttcactcattaagacccattggtgttacactcacaatgtaatgcttggagattgcctcgatttcacgacatctaatcagtatttagcaatggggataatacaacaatctgctgcagcatttccaatcttcaggactatgaaaaccatttacctaagtgatggaatcaatcgcaaaagctgttcagtcactgctataccaggaggttgtgtcttgtattgctatgtagctacaagatctgagaaagaagattatgccacaactgatctagctgaactgagacttgctttctattattataatgatacctttattgaaagagtcatatctcttccaaatacaacagggcaatgggccacaatcaatcctgcagttggaagcgggatctatcatctaggctttatcttatttcctgtatatggtggtctcataagtgggactccttcctacaacaagcagtcctcacgctattttatcccaaaacatcccaacataacctgtgccggtaactccagcgaacaggctgcagcagcacggagttcctatgtaatccgttatcactcaaacaggttgattcagagtgctgttcttatttgcccattgtctgacatgcacacagcaaggtgtaatctagttatgtttaacaattctcaagtcatgatgggtgcagaaggtaggctctatgttattgacaataatttgtattattatcaacgtagttcctcttggtggtctgcatcgcttttttacaggatcaatacagatttttctaaaggaattcctcctatcattgaggctcaatgggtaccgtcctatcaagttccccgtcctggagtcatgccatgcaatgcaacaagtttttgccctgctaattgcatcacaggggtgtacgcagatgtgtggccgcttaacgatccagaacccacatcacaaaatgctctgaatcccaactatcgatttgctggagcctttctcagaaatgagtccaaccgaaccaatcccacattctacactgcatcagccagcgccctactaaatactaccggattcaacaacaccaatcacaaagcagcatatacgtcttcaacctgctttaagaatactggaactcaaaagatttattgtttgataataattgaaatgggctcatctcttttaggggagttccaaataataccatttctaagggaactaataccttaa

SEQ ID NO: 144 - DNA, 741 bp, Parainfluenza 2
cttgcctctcagacagatcccaaaatcatagtccaaaccccaaacacagcagcagacatgcctataatatcattaccagcagatccaacttcacccagtcaatcccttactccgtttccaatacaacttgacaccaaagatggcaaggcagggaaactccttaaacagattcgaattaggtatctaaatgagcctaattctcgccatacaccaataactttcatcaatacgtatggatttgtttatgctcgagacacttcagggggcattcacagtgagatcagcagtgacctagctgcagggtccataacagcatgcatgatgaagctaggacctggtccaaatattcagaatgcaaatctagtgctaagatctctgaatgaattctacgtaaaagtcaagaagacatcaagccagagagaggaagcagtgtttgaattagttaacattccaactttattgagagaacatgctctttgcaaacgcaaaatgttagtatgctctgcagaaaaattcctcaagaacccgtcaaagctacaagctggatttgagtatgtatacataccaacttttgtctccattacatactcaccacgaaatctgaattaccaagtggccagacctatccttaagttcagatcacgctttgtgtatagcattcatttggaattaatcctgagattgctatgcaaatctgactcccccttgatgaaatcctacaatgcagacagaacaggtcgg

SEQ ID NO: 145 - DNA, 1849 bp, Parainfluenza 2
agattcggtgccggtaacgattccagttttatactatctgatcattctctatctctattaaggatatttctagtctaaagttcaaaatgtcaagtgttttaaagacatttgaaagatttactatacaacaggagcttcaggagcaatctgatgacactccagtacctcttgagacaatcaaacctacaatcagggtatttgtcatcaataataatgatcctgtcgtaagatctagacttttattctttaatctacgaatcattatgagtaacactgcaagagagggacatagagctggtgctctcctcagtcttttatcactaccttctgcagctatgagtaatcacatcaaattagccatgcattcaccagaagccagcatagatagagtagagataacagggtttgagaataattcattccgagtcattccagatgctcgatcaactatgtccagaggagaggtgctggcttttgaagcattagctgaggacattcctgatacccttaatcaccaaactccatttgtaaataatgatgtagaagatgacatatttgatgaaacagagaaattcttagatgtttgctacagtgtgcttatgcaggcatggatagtaacatgcaagtgtatgactgctcctgatcaaccaccagtatcagtagcaaagatggctaaatatcaacaacaagggagaatcaatgctaggtatgtactacaacctgaagcacaaagactaattcagaatgccatccgcaagtcaatggtagtaaggcatttcatgacttatgagcttcaactttcacaatcaagatctttgctagcaaaccgctactatgctatggtgggagacattggcaagtacattgaacacagcggaatgggaggatttttcttaacacttaaatatggacttggaacaagatggcctacattggctcttgcagcattttctggggaactccagaaattaaaagctctcatgctacattatcagagtctaggacccatggccaagtacatggctctattagaatcaccaaaactgatggattttgtcccatctgaatatccattagattatagctatgcaatgggtattggaactgtccttgatacaaatatgagaaattatgcatacggtagatcatatttaaatcagcaatattttcagctaggagtagaaacagcaaggaaacagcagggagctgttgacaacaggacagcagaggacctcggcatgactgctgcagacaaagcagacctcactgcaaccatatcaaagctatccttgtcccaattacctaggggtagacaaccaatatctgacccatttgctggagcaaatgacagagaaatgggaggacaagcaaatgatacacctgtgtataacttcaatccaatcgatactcggaggtatgacaactatgacagtgatggtgaggacagaattgacaacgatcaagatcaagctatcagagagaatagaggagagcctggacaaccaaacaaccagacaagtgacaaccagcagagattcaacccccccataccgcaaagaacatcaggtatgagcagtgaagagttccaacattcaatgaatcagtacatccgtgctatgcatgagcaatacagaggctcccaggatgatgatgccaatgatgccacagatgggaatgacatttctcttgagctagttggagattttgattcctaactctcaatgtcatacaaccagatatacacatccacatcactcagagatacagctgccactcacacactcatccagacaaatcaaactagactcacatcattcggaaacaattctctcataatttaaagaaaaaa

SEQ ID NO: 146 - DNA, 1725 bp, Parainfluenza 3
atggaatactggaagcataccaatcacggaaaggatgctggtaatgagctggagacgtccatggctactcataacaacaagctcactaataagataatatatatattatggacaataatcctggtgttattatcaatagttttcatcatagtgctaattaattccatcaatagtgaaaaggtccataattcattgctacaagaaataaataatgagtttatggagattacagaaaagatccaaatggcatcggataataccaatgatctaatacagtcaggagtgaacacaaggcttcttacaattcagagtcatgtccagaattatataccaatatcattgacacaacagatgtcggatcttaggaaattcattagtgaaattacaattagaaatgataatcaagaagtgccgcaacaaagaataacacatgatgtaggtataaaacctttaaatccagatgatttttggaggtgcacgtctggtcttccatttttaatgagaaacccaaaaataaggttaatgccagggccgggattattagccatgccaacgactgttgatggctgtgtcagaactccgtccttaattataaatgatctgatttatgcttatacctcaaatctaattactcgaggttgtcaggatataggaaaatcataccaagtcttacaggtagggataataactgtaaactcagacttggtacctgacttaaatcccaggttctctcatactttcaacataaatgacaataggaagtcatgttctctagcactcctaaatacagatgtatatcaactgtgttcaactcccaaagttgatgaaagatcagattatgcatcatcaggcatagaagatattgtacttgatattgtcaattatgatggctcaatctcaacaacaagatttaagaataataacataagctttgatcaaccctatgctgcactatacccatctgttggaccagggatatattacaaaggcaaaataatatttctcgggtatggaggtcttgaacatccaataaatgagaatgtaatctgcaacacaactgagtgtcccgggaaaacacagagagactgcaatcaggcatcttatagtccatggttttcagataggaggatggtcaactccatcattgttgttgacaaaggcttaaactcaattccaaaattaaaggtatggacaatatctatgagacaaaattactgggggtcagaaggaaggttgattctactaggtaacaagatctatatatatacaagatctacaagttggcatagcaaattacaattaggaataattgatattactgattacagtgatataaggataaaatggacatggcataatgtgctatcaagaccaggaaacgatgaatgtccatggggacattcatgtccaaatggatgtataacaggagtatatactgatgcgtatccactaaatcccacagggagcattgtgtcatctgtcatactagactcacagaaatcgagagtgaacccagtcataacttactcaacagcaactgaaagagtaaacgagctggccatcagaaacagaacactctcagctggatatacaacaacaagctgcattacacactatgacaaaggatattgttttcatatagtagaaataaatcagaaaagttcaaacacatttcaacctatgttgttcaaaacagagattccaaaaagctgcagtcaatcataa

SEQ ID NO: 147 - DNA, 544 bp, Parainfluenza 3
ccaacaaagttgctcttgctcctcaatgtcttccactagataggagcataaaatttagagtaatcttcgtgaattgtacggcaattggatcaataaccttgttcaaaattcctaagtcaatggcatcattatctctacccaacacaatatcaatcaatctgcaggtacatatcaaaacaggggttcagactgattccaaagggatagttcaaattttgaatgagaagggcgaaaaatcactgaatttcatgatccatctcggattgatcaagagaaaaataggcagaatgtactctgttgaatactgtaaacagaaaatcgagaaaatgagattgatattttctttaggattagttggaggaatcagtcttcatgtcaatgcaactggatccatatcaaaaacactagcaagtcagctggtattcaaaagggagatttgttatcctttaatggatctaaatccgcatcttaatctggttatctgggcttcatcagtagagattacaagagtggatgcaattttccaaccttctttacctggcga

SEQ ID NO: 148 - DNA, 1548 bp, Parainfluenza 3
atgttgagcctatttgatacatttaatgcacgtaggcaagaaaacataacaaaatcagccggtggagctatcattcctggacagaaaaatactgtctctatatttgctcttggaccgacaataactgatgataatgagaaaatgacattagctcttctttttttatctcattcactggataatgagaaacaacatgcacaaagggcagggttcctggtgtccttattatcaatggcttatgccaatccagagctctacctaacaacaaatggaagtaatgcagatgtcaagtatgtcatatacatgatcgagaaagatctaaaacggcaaaagtatggaggatttgtggttaagacgagagagatggtatatgacaagacaactgattggatatttggaagtgacctggattgtgatcaggaaactatgttgcagaacggaagaaacaattcaacaattgaagaccttgtccacacatttgggtatccatcatgtttaggagctcttataatacagatctggatagttctggtcaaagctatcactagtatctcagggttaagaaaaggctttttcacccgattggaagctttcagacaagatggaacagtgcaggcagggctggtattgagcggtgacacagtggatcagattgggtcaattatgcggtctcaacagagcttggtaactcttatggttgaaacattaataacaatgaatactagcagaaatgacctcacaaccatagaaaagaatatacaaattgttggtaactatataagagatgcaggtctcgcttcattcttcaatacaatcagatatggaattgagactagaatggcagctttgactctatccactctcagaccagacatcaatagattaaaagctttgatggaactgtatttatcaaagggaccacgcgctcctttcatctgtatcctcagagatcccatacatggtgagttcgcaccaggcaactatcctgccatatggagctatgcaatgggagtggcagttgtacaaaatagagccatgcaacagtatgtgacgggaagatcatatctggatattgatatgttccagctaggacaagcagtagcacgtgatgctgaagctcagatgagctcaacactagaagatgaacttggagtgacacacgaagctaaagaaagcttgaagagacatataaggaacataaatagttcagagacatctttccacaaaccaacaggtggatcagccatagagatggcaatagatgaagagccagaacaattcgaacatagatcagatcaagaacgagatggagaacctcaatcatctataattcaatatgcttgggcagaaggaaacagaagcgatgatcggactgagcaagatacagaatctgacaatatcaagactgaacaacaaaacatcagagacagactaaacaagagactcaacgaaaagaagaaacaaggcagtcaaccacctaccaatcccacaaacagaacgaatcaggacgaaatagatgatctgtttaatgcatttggaagcaactaa

SEQ ID NO: 149 - DNA, 686 bp, Parainfluenza 4
gacgggaggaatcgaaagagttgttcagtggttgctgtccccgacggatgcctgcggaattgtgtgaccatgacaaaaaatgagacagagaatttcaaagacctcaattggcaacacaattacttacatacatatcatataatggtaccattaaagactcgtataataaatccaccaggatcatccagagattgggttcatatcgcaccaggggtaggctcgggccttttgtatgccaaattacttatatttcctttgtatgggggtctcacggaaaaatcagtgatacataataatcaatcagggaaatattttttccctaattcaactaaattgcaatgccgtaacagcactatggaaaaaataaaaggagcaaaagattcatacacaataacttacttctcagggagacttatacagagtgcatttctggtttgtgatctaagacaatttctttctgaagattgtgaaatcttaattcctagtaatgattacatgatggtcggtgcagagggtcgattatataacattgagaacaacatattttattatcagagaggatccagctggtggccttatccgagcctctatagaatcaggttaaaccttagtaagaaatatcctagaataactgaaattaaatttacaaaaattgaaatcgccccaagaccaggcaacaaagattg

SEQ ID NO: 150 - DNA, 855 bp, Parainfluenza 4
ggaacggtaccgactgcaattagatctctagtttactacacttataccaaaccatcttatctcactgtagatttgattcccaatttgaagaatctggaccaaaattgcaattactcaagcttaaactactacaacaaaactgcactaagcctaattcaaccaattgcagataacatcaatcgccttacaaagcccatcacaagctcagaaattcaaagtcgtttctttggggcagtcataggtacaattgctcttggtgtagccaccgctgcacaagttacagcagcaatcggtctagcaaaagctcaagaaaatgcaaaacttatactaactctcaaaaaagctgcgacagaaacaaatgaggcagttcgagatcttgcaaactctaataaaattgtagtaaaaatgatatcagcaattcaaaatcaaataaacactattattcttcctgctatagatcagattaattgtcaaattaaagacctacaagttgccaatattttaaatttgtacctaacagagataacgactgttttccacaaccaattgaccaatcctgcattagagtcaattagcatcagctctcaaagctctaggactacctacctaccagaagtgtcatctaaattagatttaaacaacatctcggcagcttcagtgatggcatccggcttaattaaaggacagataattgcagttgatataccgactatgacactagtattgatggtccaaataccgagtatatcccctttaagacaagcaaagataatagatctaacttctataacaattcacacaaatagccaagaagtacaggctgtagtaccggctaggtttctcgagattggctca

SEQ ID NO: 151 - DNA, 520 bp, Rhinovirus 14, AF108186
tgatgtacctttgtacgcctgtttattcccaaacccccacccgttattcgcccaacccctgtaacgttagaagtttggaacttaattgtacaatagggagcaccatatccaatggtgtaacgtacaagcacttctgtttccccggagcgaggtataggtggtacccactgccgaaagcctttaaccgtcatccgccaatcaactacgtaacagctagtaacatcttgttgttgattggacgttcgatcaggtggttcaccccccactagtttggtcgatgaggctgggaatcccccacgggtgaccgtgtcccagcctgcgtggcggccaacccagcttatgctgggacgccctttcaatgacatggtgtgaagactcgcatgtgcttgattgtgagtccgccggcccctgaatgcggctaaccctaaccctggagccttgcaccacaatccagtggtgtctgggtcgtaatgagtaattctgggatgggaccgactactttgggtgtccgtgtttctca

SEQ ID NO: 152 - DNA, 511 bp, Rhinovirus 1A, AF108179
ttccggtaactttgtacgccagtttttccctcccctccccatccttttacgtaacttagaagttttaaatacaagaccaatagtaggcaactctccaggttgtctaaggtcaagcacttctgtttccccggttgatgttgatatgctccaacagggcaaaaacaacagataccgttatccgcaaagtgcctacacagagcttagtaggattctgaaagatctttggttggtcgttcagctgcatacccagcagtagaccttgcagatgaggctggacattccccactggtaacagtggtccagcctgcgtggctgcctgcgcacctctcatgaggtgtgaagccaaagatcggacagggtgtgaagagccgcgtgtgctcactttgagtcctccggcccctgaatgcggctaaccttaaacctgcagccatggctcataagccaatgagtttatggtcgtaatgagtaattgcgggatgggaccgactactttgggtgtccgtgtttcact

SEQ ID NO: 153 - DNA, 499 bp, Rhinovirus 21, AF108180
ttccggtaattttgtacgccagttttatctccccttccccaattgcaacttagaagtttatcaatatgaccaataggcggtagttagccaaactaccagaggtcaagcacttctgtttccccggtcaaagttgatatgctccaacagggcaaaaacaactgagatcgttatccgcaaagtgcctacgcaaagcctagtaacacctttgaagatttatggttggtcgttccgctatttcccatagtagacctggcagatgaggctagaaattccccactggcgacagtgttctagcctgcgtggctgcctgcgcaccccttgggtgcgaagccatacattggacaaggtgtgaagagccccgtgtgctcactttgagtcctccggcccctgaatgtggctaaccttaaccctgcagctagtgcatgtaatccaacatgttgctagtcgtaatgagcaattgcgggacgggaccaactactttgggtgtccgtgtttcact

SEQ ID NO: 154 - DNA, 676 bp, Rhinovirus 29, AF542420
cgaaaacaatttaaatcgttatccgcaaaatgactacgcaaagcctagtaacatcttgaagaacttatggttggtcgttccactaaaccccatagtagacctggcagatgaggctagaaataccccactggagacagtgttctagcctgcgtggctgcctgcacaccctatgggtgtgaagccatatttttgacaaggtgtgaagagccccgtgtgctcattttgagtcctccggcccctgaatgtggctaaccttaaccctgcagctagtgcatgcaatccagcatgttgctagtcgtaatgagcaattgcgggatgggaccaactactttgggtgtcgaaaacaatttaaatcgttatccgcaaaatgactacgcaaagcctagtaacatcttgaagaacttatggttggtcgttccactaaaccccatagtagacctggcagatgaggctagaaataccccactggagacagtgttctagcctgcgtggctgcctgcacaccctatgggtgtgaagccatatttttgacaaggtgtgaagagccccgtgtgctcattttgagtcctccggcccctgaatgtggctaaccttaaccctgcagctagtgcatgcaatccagcatgttgctagtcgtaatgagcaattgcgggatgggaccaactactttgggtgt

SEQ ID NO: 155 - DNA, 504 bp, Rhinovirus 58, AF108183
tcacggtaactttgtatgccagttttgccacccttccccgtagcgtaacttagaagtttgtacacttagaccaataggcgataatcatccagattatcaaaggtcaagcacttctgtttccccggtcaatgaggatatgcttttcccaaggcaaaaaccttagagatcgttatccccacattgcctacacagagcctagtatcacctttgatgtatttagactggtcgctccctgcaaacccagcagtagacctggcagatgaggctggacgttccccactggcgacagtggtccagcctgcgtggctgcctgcccacccatttgggggaaaagcctaactattgacatggtgtgaagagccgcgtgtgctcaatgtgcctcctccggcccctgaatgtggctaaccttaaccccgcagccgctgcccatggatccagtgggtatacggtcgtaacgcgcaatgtggggatgggaccaactactttgggtgtccgtgtttcctg

SEQ ID NO: 156 - DNA, 501 bp, Rhinovirus 62, AF108184
ttccggtaatcttgtacgccagttttatattccctaccccttttgtaacttagaagttaagcacacagaccaataggcggtgaccacccaagtcactaacggtcaagcacttctgtttccccggttaagattgatacgctccaacagggcgaaaacaatctaaatcgttaaccgcaaagtgactacgcaaagcttagtaataccttgaagaatttatggctggtcgttccgctataacccctagtagacctggcagatgaggctagaaataccccactggtaacagtgttctagcctgcgtggctgcctgcacaccctttttgggtgtgaagccatatatttgacaaggtgtgaagagccccgtgtgctcactttgagtcctccggcccctgaatgtggctaaccttaaccctgcagctagtgtatgtaatccaacatatggctagtcgtaatgagcaattgcgggatgggaccaactactttgggtgtccgtgtttcact

SEQ ID NO: 157 - DNA, 506 bp, Rhinovirus 87, AF108187
tcttggtacctttgtacgcctgttttaattccctccccaacctaacttagaagctttcaaaccaaagctcaataggtggagcgcaaaccagcgctcttatgagcaagcacttctgtctccccggtgcggttgcatagactgtccccacggttgaaaacaacttatccgttaaccgctatagtacttcgagaaacctagtatcaccttcggagtgtcgatgcgttgcgctcagcacactaacccgtgtgtagcttgggtcgatgagtctggacgtaccccactggcgacagtggtccaggctgcgttggcggcctactcatggtgaaaaccatgagacgctagacatgaacaaggtgtgaagagtttattgagctactatagagtcctccggcccctgaatgcggctaatcctaaccatggagcaagtgctcacaaaccagtgggttgcttgtcgtaacgcgcaagtccgtggcggaaccgactactttgggtgtccgtgtttcact

SEQ ID NO: 158 - DNA, 508 bp, Rhinovirus 95-01468, AF108164
ttccggtaattttgtacgccagttttatcttcccctaccccctttatgtaacttagaagttttgcacataccgaccaataggtggtatttaaccaaaataccaaaggtcaagcacttctgttaccccggtcaagattgatatgctccaccagggcaaaaacaattgcgatcgttatccgcaaagcaactacgcaaagcctagtatcatttttgatggtgtatggttggtcgttccgctatgaacccgatagtagacctggcagatgaggctagagaatccccactggtaacagtgttctagcctgcgtggctgcctgcgtaccccttgtgggtacgaagccatacatttgacaaggtgtgaagagccccgtgtgcttgctttgagtcctccggcccctgaatgtggctaaccctaaccctgcagctagtgtgtacaaaccagtgcatagctagtcgtaacgagcaattgcgggatgggaccaactactttgggtgtccgtgtttcttg

SEQ ID NO: 159 - DNA, 379 bp, RSV A&B; identical to SEQ ID NO: 23

SEQ ID NO: 160 - DNA, 958 bp, RSV A, 3089371:3253-4210
ggggcaaatatggaaacatacgtgaacaagcttcacgaaggctccacatacacagctgctgttcaatacaatgtcttagaaaaagacgatgaccctgcatcacttacaatatgggtgcccatgttccaatcatctatgccagcagatttacttataaaagaactagctaatgtcaacatactagtgaaacaaatatccacacccaagggaccttcactaagagtcatgataaactcaagaagtgcagtgctagcacaaatgcccagcaaatttaccatatgcgctaatgtgtccttggatgaaagaagcaaactagcatatgatgtaaccacaccctgtgaaatcaaggcatgtagtctaacatgcctaaaatcaaaaaatatgttgactacagttaaagatctcactatgaagacactcaaccctacacatgatattattgctttatgtgaatttgaaaacatagtaacatcaaaaaaagtcataataccaacatacctaagatccatcagtgtcagaaataaagatctgaacacacttgaaaatataacaaccactgaattcaaaaatgctatcacaaatgcaaaaatcatcccttactcaggattactattagtcatcacagtgactgacaacaaaggagcattcaaatacataaagccacaaagtcaattcatagtagatcttggagcttacctagaaaaagaaagtatatattatgttaccacaaattggaagcacacagctacacgatttgcaatcaaacccatggaagattaacctttttcctctacatcagtgtgttaattcatacaaactttctacctacattcttcacttcaccatcacaatcacaaacactctgtggttcaaccaatcaaacaaaacttatctgaagtcccagatcatcccaagtcattgtttatcagatctagtactcaaataagttaataaaaaa

SEQ ID NO: 161 - DNA, 955 bp, RSV A, 3089371:1126-2398
tccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcgattaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaa

SEQ ID NO: 162 - DNA, 770 bp, RSV B, 2582022:3263-4033
atggaaacatacgtgaacaagcttcacgaaggctccacatacacagcagctgttcagtacaatgttctagaaaaagatgatgatcctgcatcactaacaatatgggtgcctatgttccagtcatctgtaccagcagacttgctcataaaagaacttgcaagcatcaacatactagtgaagcagatctctacgcccaaaggaccttcactacgagtcacgattaactcaagaagtgctgtgctggctcaaatgcctagtaatttcatcataagcgcaaatgtatcattagatgaaagaagcaaattagcatatgatgtaactacaccttgtgaaatcaaagcatgcagtctaacatgcttaaaagtgaaaagtatgttaactacagtcaaagatcttaccatgaagacattcaaccccactcatgagatcattgctctatgtgaatttgaaaatattatgacatcaaaaagagtaataataccaacctatctaagaccaattagtgtcaaaaacaaggatctgaactcactagaaaacatagcaaccaccgaattcaaaaatgctatcaccaatgcgaaaattattccctatgctggattagtattagttatcacagttactgacaataaaggagcattcaaatatatcaagccacagagtcaatttatagtagatcttggtgcctacctagaaaaagagagcatatattatgtgactactaattggaagcatacagctacacgtttttcaatcaaaccactagaggatta

SEQ ID NO: 163 - DNA, 602 bp, RSV B, 2582022:1140-2315
gatgggagaagtggctccagaatataggcatgattctccagactgtgggatgataatactgtgtatagcagcacttgtaataaccaaattagcagcaggagacagatcaggtcttacagcagtaattaggagggcaaacaatgtcttaaaaaatgaaataaaacgctacaagggtctcataccaaaggatatagctaacagtttttatgaagtgtttgaaaaacaccctcatcttatagatgtttttgtgcactttggcattgcacaatcatcaacaagagggggtagtagagttgaaggaatctttgcaggattgtttatgaatgcctatggttcagggcaagtaatgctaagatggggagttttagccaaatctgtaaaaaatatcatgctaggtcatgctagtgtccaggcagaaatggagcaagttgtggaagtctatgagtatgcacagaagttgggaggagaagctggattctaccatatattgaacaatccaaaagcatcattgctgtcattaactcaatttcctaacttctcaagtgtggtcctaggcaatgcagcaggtctaggcataatgggagagtatagaggtacgccaa

SEQ ID NO: 164 - DNA, 1534 bp, Coronavirus 229E, 12175745:20570-24091
gttgattgctccacttatgtttgcaatggtaatgtgcgctgtgttgaattgcttaagcagtatacttctgcttgtaaaactattgaagacgccttaagaaatagcgccaggctggagtctgcagatgttagtgagatgctcacttttgacaagaaagcgtttacacttgctaatgttagtagttttggtgactacaaccttagcagcgtcatacctagcttgcccacaagtggtagtagagtggctggtcgcagtgccatagaagacatactttttagcaaacttgttacttctggacttggcactgtggacgcagactacaaaaagtgcactaagggtctttccattgctgacttggcttgtgctcaatattataatggcattatggttttgcctggcgtcgctgatgctgaacgaatggccatgtatacaggttctttaattggtggaattgctttaggaggtctaacatcagccgtttcaataccattttcattagcaattcaggcacgtttaaattatgttgcattgcagactgatgttttacaagaaaatcagaaaattcttgctgcatcttttaacaaagcaatgaccaacatagtagatgcctttactggtgttaatgatgctattacacaaacttcacaagccctacaaacagttgctactgcacttaacaagatccaggatgttgttaatcaacaaggcaactcattgaaccatttaacttctcagttgaggcagaattttcaagctatctctagctctattcaggctatctatgacagacttgacactattcaggctgatcaacaagtagataggctgattactggtagattggctgctttgaatgtattcgtttctcatacattgactaagtacactgaagttcgtgcttccagacagcttgcacaacaaaaagtgaatgagtgtgtcaaatcccagtctaagcgttatggcttctgtggaaatggcactcacattttctcaattgttaatgctgctcctgaggggcttgtttttctccacactgtcttgttgccgacacaatataaggatgttgaagcgtggtctgggttgtgcgttgatggtacaaacggttatgtgttgcgacaacctaatcttgctctttacaaagaaggcaattattatagaatcacatctcgcataatgtttgaaccacgtattcctaccatggcagattttgttcaaattgaaaattgcaatgtcacatttgttaacatttctcgctctgagttgcaaaccattgtgccagagtatattgatgttaataagacgctgcaagaattaagttacaaattgccaaattacactgttccagacctagttgtcgaacagtacaaccagactattttgaatttgaccagtgaaattagcacccttgaaaataaatctgcggagcttaattacactgttcaaaaattgcaaactctgattgacaacataaatagcacattagtcgacttaaagtggctcaaccgggttgagacttacatcaagtggccgtggt

SEQ ID NO: 165 - DNA, 678 bp, Coronavirus 229E, 12175745:24995-25672
atgtcaaatgacaattgtacgggtgacattgtcacccatttgaagaattggaattttggttggaatgttattctaaccatattcattgttattcttcagtttggacactataaatactccagattgttttatggtttgaagatgcttgtactgtggcttctttggccactcgtacttgctttgtcaatctttgacacctgggctaattgggattctaattgggcctttgttgcatttagcttttttatggccgtatcaacactcgttatgtgggtgatgtacttcgcaaacagtttcagacttttccgacgtgctcgaactttttgggcatggaatcctgaggttaatgcaatcactgtcacaaccgtgttgggacagacatactatcaacccattcaacaagctccaacaggcattactgtgaccttgctgagcggcgtgctttacgttgacggacatagattggcttcaggtgttcaggttcataacctacctgaatacatgacagttgccgtgccgagcactactataatttatagtagagtcggaaggtccgtaaattcacaaaatagcacaggctgggttttctacgtacgagtaaaacacggtgatttttctgcagtgagctctcccatgagcaacatgacagaaaacgaaagattgcttcattttttctaa

SEQ ID NO: 166 - DNA, 924 bp, Coronavirus 229E, 12175745:25686-26855
atggctacagtcaaatgggctgatgcatctgaaccacaacgtggtcgtcagggtagaataccttattctctttatagccctttgcttgttgatagtgaacaaccttggaaggtgatacctcgtaatttggtacccatcaacaagaaagacaaaaataagcttataggctattggaatgttcaaaaacgtttcagaactagaaagggcaaacgggtggatttgtcacccaagctgcatttttattatcttggcacaggaccccataaagatgcaaaatttagagagcgtgttgaaggtgtcgtctgggttgctgttgatggtgctaaaactgaacctacaggttacggtgttaggcgcaagaattcagaaccagagataccacacttcaatcaaaagctcccaaatggtgttactgttgttgaagaacctgactcccgtgctccttcccggtctcagtcgaggtcgcagagtcgcggtcgtggtgaatccaaacctcaatctcggaatccttcaagtgacagaaaccataacagtcaggatgacatcatgaaggcagttgctgcggctcttaaatctttaggttttgacaagcctcaggaaaaagataaaaagtcagcgaaaacgggtactcctaagccttctcgtaatcagagtcctgcttcttctcaaacttctgccaagagtcttgctcgttctcagagttctgaaacaaaagaacaaaagcatgaaatgcaaaagccacggtggaaaagacagcctaatgatgatgtgacatctaatgtcacacaatgttttggccccagagaccttgaccacaactttggaagtgcaggtgttgtggccaatggtgttaaagctaaaggctatccacaatttgctgagcttgtgccgtcaacagctgctatgctgtttgatagtcacatt

SEQ ID NO: 167 - DNA, 1456 bp, Coronavirus OC43, 38018022:23644-27729
attgattgtgctgcatttgtctgtggtgattatgcagcatgtaaatcacagttggttgaatatggtagtttctgtgataacattaatgccatactcacagaagtaaatgaactacttgacactacacagttgcaagtagctaatagtttaatgaatggtgttactcttagcactaagcttaaagatggcgttaatttcaatgtagacgacatcaatttttcccctgtattaggttgtctaggcagcgaatgtagtaaagcttccagtagatctgctatagaggatttactttttgataaagtaaagttatctgatgtcggttttgttgaggcttataataattgtacaggaggtgccgaaattagggacctcatttgtgtgcaaagttataaaggcatcaaagtgttgcctccactgctctcagaaaatcagatcagtggatacactttggctgccacctctgctagtctatttcctctttggacagcagcagcaggtgtaccattttatttaaatgttcagtatcgcattaatgggcttggtgtcaccatggatgtgctaagtcaaaatcaaaagcttattgctaatgcatttaacaatgccctttatgctattcaggaagggttcgatgcaactaattctgctttagttaaaattcaagctgttgttaatgcaaatgctgaagctcttaataacttattgcaacaactctctaatagatttggtgctataagtgcttctttacaagaaattctatctagacttgatgctcttgaagcggaagctcagatagatagacttattaatggtcgtcttaccgctcttaatgcttatgtttctcaacagcttagtgattctacactggtaaaatttagtgcagcacaagctatggagaaggttaatgaatgtgtcaaaagccaatcatctaggataaatttctgtggtaatggtaatcatattatatcattagtgcagaatgctccatatggtttgtattttatccactttagttatgtccctactaagtatgtcacagcgagggttagtcctggtctgtgcattgctggtgatagaggtatagctcctaagagtggttattttgttaatgtaaataatacttggatgtacactggtagtggttactactaccctgaacctataactgaaaataatgttgttgttatgagtacctgcgctgttaattatactaaagcgccgtatgtaatgctgaacacttcaatacccaaccttcctgattttaaggaagagttggatcaatggtttaaaaatcaaacatcagtggcaccagatttgtcacttgattatataaatgttacattcttggacctacaagttgaaatgaataggttacaggaggcaataaaagtcttaaatcagagctacatcaatctcaaggacattggtacatatgaatattatgtaaaatggccttggt

SEQ ID NO: 168 - DNA, 693 bp, Coronavirus OC43, 38018022:28402-29094
atgagtagtaaaactacaccagcaccagtttatatctggactgctgatgaagctattaaattcctaaaggaatggaatttttctttgggtattatactactttttattacaatcatattgcaatttggatatacaagtcgcagtatgtttgtttatgttattaagatgattattttgtggcttatgtggccccttactataatcttaactattttcaattgcgtatacgcattgaataatgtgtatcttggcctttctatagtttttaccatagtggccattattatgtggattgtgtattttgtgaatagtatcaggttgtttattagaactggaagtttttggagtttcaacccagaaacaaacaacttgatgtgtatagatatgaaaggaacaatgtatgttaggccgataattgaggactatcatactctgacggtcacaataatacgcggccatctttacattcaaggtataaaactaggtactggctattctttggcagatttgccagcttatatgactgttgctaaggttacacacctgtgcacatataagcgtggttttcttgacaggataagcgatactagtggttttgctgtttatgttaagtccaaagtcggtaattaccgactgccatcaacccaaaagggttctggcatggacaccgcattgttgagaaataatatctaa

SEQ ID NO: 169 - DNA, 966 bp, Coronavirus OC43, 38018022:29104-30450
agagctcaacccaagcaaactgctacctctcagcaaccatcaggagggaatgttgtaccctactattcttggttctctggaattactcagtttcaaaagggaaaggagtttgagtttgtagaaggacaaggtgtgcctattgcaccaggagtcccagctactgaagctaaggggtactggtacagacacaacagacgttcttttaaaacagccgatggcaaccagcgtcaactgctgccacgatggtatttttactatctgggaacaggaccgcatgctaaagaccagtacggcaccgatattgacggagtctactgggtcgctagcaaccaggctgatgtcaataccccggctgacattgtcgatcgggacccaagtagcgatgaggctattccgactaggtttccgcctggcacggtactccctcagggttactatattgaaggctcaggaaggtctgctcctaattccagatctacttcgcgcacatccagcagagcctctagtgcaggatcgcgtagtagagccaattctggcaatagaacccctacctctggtgtaacacctgacatggctgatcaaattgctagtcttgttctggcaaaacttggcaaggatgccactaaacctcagcaagtaactaagcatactgccaaagaagtcagacagaaaattttgaataagccccgccagaagaggagccccaataaacaatgcactgttcagcagtgttttggtaagagaggccctaatcagaattttggtggtggagaaatgttaaaacttggaactagtgacccacagttccccattcttgcagaactcgcacccacagctggtgcgtttttctttggatcaagattagagttggccaaagtgcagaatttatctgggaatcctgacgagccccagaaggatgtttatgaattgcgctataacggcgcaattaggtttgacagtacactt

SEQ ID NO: 170 - DNA, 1438 bp, Coronavirus SARS(Urbani), 30027617:21492-25259
gtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagctcgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggt

SEQ ID NO: 171 - DNA, 666 bp, Coronavirus SARS(Urbani), 30027617:26398-27063
atggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacaccccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaa

SEQ ID NO: 172 - DNA, 932 bp, Coronavirus SARS(Urbani), 30027617:28120-29388
atggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagat

SEQ ID NO: 173 - DNA, 1534 bp, Coronavirus NL63, AY567487:20472-24542
gttgattgtgctacttatgtgtgtaatggtaaccctcgctgtaagaatctacttaagcagtatacttctgcttgtaaaactattgaagatgccttacgacttagtgctcatttggaaactaatgatgttagtagtatgctaactttcgatagcaatgcttttagtttggctaatgttactagttttggagattataacctttctagtgttttacctcagagaaacattcgttcaagccgtatagcaggacgtagtgctttggaagatttgttgtttagcaaagttgttacatctggtttgggtactgttgatgttgactataagtcttgtactaaaggtctttctattgctgaccttgcttgtgctcagtactacaatggcataatggttttgccaggtgttgctgatgctgaacgtatggccatgtacacaggttctcttataggtggcatggtgctcggaggtcttacatcagcagccgccatacctttttctttggcactgcaagcacgacttaactatgttgctttacaaactgatgtgcttcaagaaaatcagaaaattttggctgcatcatttaataaggctattaataatattgttgcttcttttagtagcgttaatgatgctattacacaaactgcagaggctatacatactgttactattgcacttaataagattcaggatgttgttaatcaacagggtagtgctcttaaccatctcacttcacaattgagacataattttcaggccatttctaattcaattcaggctatttatgaccggcttgattcaattcaagccgatcaacaagttgacagattaattactggacggcttgcagctttgaatgcatttgtttcccaagttttgaataaatatactgaagttcgtggttcaagacgcttagcacagcagaagattaatgaatgtgtcaagtcacaatctaatagatatggtttttgtggcaatggcactcacatcttttcaatcgtcaactcagctccagatggtttgctttttcttcatactgttttgctgccaactgattacaagaatgtaaaggcgtggtctggtatctgtgttgatggcatttatggctatgttctgcgtcaacctaacttggttctttattctgataatggtgtctttcgtgtaacttccagggtcatgtttcaacctcgcttacctgttttgtctgattttgtgcaaatatataattgtaatgttacttttgttaacatatctcgtgttgagttacatactgtcatacctgactacgttgatgttaataaaacattacaagagtttgcacaaaacttaccaaagtatgttaagcctaattttgacttgactccttttaatttaacatatcttaatttgagttctgagttgaagcaactcgaagctaaaactgctagtctttttcaaactactgttgaattacaaggtcttattgatcagattaacagtacatatgttgatttgaagttgcttaataggtttgaaaattatatcaaatggccttggt

SEQ ID NO: 174 - DNA, 678 bp, Coronavirus NL63, AY567487:24542-25219
atgccttttggtggcctatttcaacttactcttgaaagtactattaataagagtgtggctaatctcaaattaccacctcatgatgttactgtcttgcgtgacaatcttaaacctgttactacacttagtactattactgcttatttgttagttagtttgtttgtcacttactttgctttattcaaacctcttactgctagaggtcgtgttgcttgttttgttttaaaactattgacactatttgtctatgtgcctttattggttctttttggtatgtatcttgacagttttataattttttctacgctgttgtttcgattcatacatgttggctattatgcctatctctataaaaatttttcatttgttttgttcaatgttactaaactatgcttcgtttcaggcaagtgttggtatcttgaacaatcattttatgaaaatcgttttgctgctatttatggtggtgaccactatgtcgttttaggtggtgaaactattacttttgtttcttttgatgacctttatgttgctattagaggttcttgtgaaaagaacctacaacttatgcgtaaggttgacttgtataatggtgctgtcatttacatttttgccgaagagcctgttgttggtatagtctactcttctcaactatacgaagatgttccttcgattaattga

SEQ ID NO: 175 - DNA, 681 bp, Coronavirus NL63, AY567487:25442-26122
atgtctaatagtagtgtgcctcttttagaggtttatgtccatttacgtaactggaactttagttggaatttaattctaacgctttttatagttgtgttgcagtatgggcattataagtatagcagacttctttatggtttaaagatgtctgttttatggtgtttatggccacttgttctagctttgtctatttttgactgttttgtcaattttaatgtggactgggtcttttttggttttagtattcttatgtctattattacactttgtttatgggttatgtattttgttaatagtttcagactttggcgccgtgttaaaactttttgggcttttaatcctgaaactaatgcaatcatctctctccaggtttacggacataattattacttaccggtgatggctgcacctacaggtgttacattaacacttcttagtggtgtacttcttgttgatggccataagattgctactcgtgttcaagtgggtcagttgcctaaatatgtaatagttgctacgcctagtaccacaattgtttgtgaccgtgttggtcgctctgttaatgaaacaagccagactggttgggcattctacgtccgtgctaaacatggtgatttttctggtgttgcctctcaggagggtgttttgtcagaaagagagaagttgcttcatttaatctaa

SEQ ID NO: 176 - DNA, 879 bp, Coronavirus NL63, AY567487:26133-27266
atggctagtgtaaattgggccgatgacagagctgctaggaagaaatttcctcctccttcattttacatgcctcttttggttagttctgataaggcaccatatagggtcattcccaggaatcttgtccctattggtaagggtaataaagatgagcagattggttattggaatgttcaagagcgttggcgtatgcgcagggggcaacgtgttgatttgcctcctaaagttcatttttattacctaggtactggacctcataaggaccttaaattcagacaacgttctgatggtgttgtttgggttgctaaggaaggtgctaaaactgttaataccagtcttggtaatcgcaaacgtaatcagaaacctttggaaccaaagttctctattgctttgcctccagagctctctgttgttgagtttgaggatcgctctaataactcatctcgtgctagcagtcgttcttcaactcgtaacaactcacgagactcttctcgtagcacttcaagacaacagtctcgcactcgttctgattctaaccagtcttcttcagatcttgttgctgctgttactttggctttaaagaacttaggttttgataaccagtcgaagtcacctagttcttctggtacttccactcctaagaaacctaataagcctctttctcaacccagggctgataagccttctcagttgaagaaacctcgttggaagcgtgttcctaccagagaggaaaatgttattcagtgctttggtcctcgtgattttaatcacaatatgggggattcagatcttgttcagaatggtgttgatgccaaaggttttccacagcttgctgaattgattcctaatcaggctgcgttattctttgatagtgaggtt

SEQ ID NO: 177 - DNA, 765 bp, Metapneumovirus, AY145271
atggagtcctacctagtagacacctatcaaggcatcccttacacagcagctgttcaagttgatctagtagaaaaggacctgttacctgcaagcctaacaatatggttccccctgtttcaggccaatacaccaccagcagttctgcttgatcagctaaagacactgactataactactctgtatgctgcatcacaaagtggtccaatactaaaagtgaatgcatcagcccagggtgcagcaatgtctgtacttcccaaaaagtttgaagtcaatgcgactgtagcacttgacgaatatagcaaattggaatttgacaaacttacagtctgtgaagtaaaaacagtttacttaacaaccatgaaaccatatgggatggtatcaaagtttgtgagctcggccaaatcagttggcaaaaaaacacatgatctgatcgcattatgtgattttatggatctagaaaagaacacaccagttacaataccagcatttatcaaatcggtttctatcaaagagagtgaatcagccactgttgaagctgcaataagcagtgaagcagaccaagctctaacacaagccaaaattgcaccttatgcgggactgatcatgattatgaccatgaacaatcccaaaggcatattcaagaagcttggagctgggacccaagttatagtagaactaggagcatatgtccaggctgaaagcataagtaaaatatgcaagacttggagccatcaaggaacaagatatgtcttgaagtccagataa

SEQ ID NO: 178 - DNA, 1185 bp, Metapneumovirus, AY145272
atgtctcttcaagggattcacctgagtgatctatcatacaagcatgctatattaaaagagtctcagtatacaataaagagagatgtaggcacaacaaccgcagtgacaccctcatcattgcaacaagaaataacactattgtgtggagaaattctatatgctaagcatgctgattacaaatatgctgcagaaataggaatacaatatattagcacagctctaggatcagagagagtacagcagattctaagaaactcaggcagtgaagtccaagtggttttaaccagaacgtactccttggggaaagttaaaaacaacaaaggagaagatttacagatgttagacatacacggagtagagaaaagctgggtggaagagatagacaaagaagcaagaaaaacaatggcaactttgcttaaagaatcatcaggcaatattccacaaaatcagaggccttcagcaccagacacacccataatcttattatgtgtaggtgccttaatatttaccaaactagcatcaactatagaagtgggattagagaccacagtcagaagagctaaccgtgtactaagtgatgcactcaaaagataccctaggatggacataccaaaaatcgctagatctttctatgacttatttgaacaaaaggtgtattacagaagtttgttcattgagtatggcaaagcattaggctcatcctctacaggcagcaaagcagaaagtttattcgttaatatattcatgcaagcttatggtgctggtcaaacaatgctgagatggggagtcattgccaggtcatctaacaatataatgttaggacatgtatctgtccaagctgagttaaaacaagtcacagaagtctatgacctggtgcgagaaatgggccctgaatctgggctcctacatttaaggcaaagcccaaaagctggattgttatcactagccaattgtcccaactttgcaagtgttgttctcggcaatgcctcaggcttaggcatgataggtatgtatcgcgggagagtgccaaacacagaactattttcagcagcagaaagctatgccaagagtttgaaagaaagcaataaaattaacttttcttcattaggactcacagatgaagaaaaagaggctgcagaacacttcctaaatgtgagtgacgacagtcaaaatgattatgagtaa

SEQ ID NO: 179 - DNA, 1061 bp, Human herpesvirus 1 (Simplex), 9629378:62807-66514
taccagggggccagggtccttgaccccacttccgggtttcacgtgaaccccgtggtggtgttcgactttgccagcctgtaccccagcatcatccaggcccacaacctgtgcttcagcacgctctccctgagggccgacgcagtggcgcacctggaggcgggcaaggactacctggagatcgaggtgggggggcgacggctgttcttcgtcaaggctcacgtgcgagagagcctcctcagcatcctcctgcgggactggctcgccatgcgaaagcagatccgctcgcggattccccagagcagccccgaggaggccgtgctcctggacaagcagcaggccgccatcaaggtcgtgtgtaactcggtgtacgggttcacgggagtgcagcacggactcctgccgtgcctgcacgttgccgcgacggtgacgaccatcggccgcgagatgctgctcgcgacccgcgagtacgtccacgcgcgctgggcggccttcgaacagctcctggccgatttcccggaggcggccgacatgcgcgcccccgggccctattccatgcgcatcatctacggggacacggactccatctttgtgctgtgccgcggcctcacggccgccgggctgacggccgtgggcgacaagatggcgagccacatctcgcgcgcgctgtttctgccccccatcaaactcgagtgcgaaaagacgttcaccaagctgctgctgatcgccaagaaaaagtacatcggcgtcatctacgggggtaagatgctcatcaagggcgtggatctggtgcgcaaaaacaactgcgcgtttatcaaccgcacctccagggccctggtcgacctgctgttttacgacgataccgtctccggagcggccgccgcgttagccgagcgccccgcggaggagtggctggcgcgacccctgcccgagggactgcaggcgttcggggccgtcctcgtagacgcccatcggcgcatcaccgacccggagagggacatccaggactttgtcctcaccgccgaactgagcagacacccgcgcgcgtacaccaacaagcgcct

SEQ ID NO: 180 - DNA, 993 bp, Human herpesvirus 1 (Simplex), 9629378:c40528-36404
cgggcgccaacaccgcgtccaccaccaacatgcgcatattcgacggggcgttgcacgccggaatcctgctgatggccccccagcatctggaccataccatccaaaatggcgactatttttaccccctccccgtccacgcgctgttcgccggggccgaccacgtggcgaacgcgcccaatttccccccggccctgcgcgacctgtcgcggcaggtccccctggtccccccggctctgggggccaactacttttcgtcgatccgacagcccgtcgtgcagcacgtccgcgagagcgcggccggggagaacgcgctgacctacgcgctcatggcggggtacttcaagatcagtcccgtggccttgcatcatcagctcaagacgggcctccatcccgggtttgggttcaccgtcgtccgacaggaccgctttgtgactgagaacgtgctgttctcggagcgcgcgtcggaggcgtacttcctgggccagctccaggtggcccggcacgaaactggcgggggggtaaacttcacgctcacccagccgcgcgcgaacgtggacctgggcgtgggctacaccgccgtcgtggccacggcaaccgtccgcaaccccgtcaccgacatgggcaaccttccccaaaacttttacctgggccgcggggctccccctctcctggacaacgcggcagccgtgtacctgcggaacgcggtcgtggcgggaaaccgcctggggccggcccagcccgtccccgtgttcgggtgcgcccaggtgccgcggcgcgcagggatggaccacggccaggacgccgtgtgtgagtttatcgccacccccgtgtcgaccgacgtcaactacttccgccggccctgcaacccccggggacgcgccgccgggggcgtttacgcgggggacaaggagggggatgtcaccgccctcatgtacgaccacggccagagcgacccgtcccgggccttcgcggccacggccaacccgtgggcgt

SEQ ID NO: 181 - DNA, 1061 bp, Human herpesvirus 3 (VZV), 9625875:c50636-47052
tataaaggagccagggtttttgaccctgatacgggattttatatcgatccggtggtcgtattggattttgcaagtttatatccaagtataattcaggcccataacttatgttttaccacgctaacgttaaattttgagacggttaaacgtttgaatccatccgattatgccacctttacagttggaggaaaacgtcttttttttgtgcgctctaacgttcgagaaagtctgctgggtgttcttttaaaagactggttggctatgcgcaaggctattagagcgcgcatacccggaagttcttcagatgaagcagtgttattagacaaacaacaagccgcgataaaagtagtttgtaattccgtgtacggttttactggagttgcgcagggatttctgccatgtttatacgtagcggccactgtcactacaattggccgtcaaatgttattaagtaccagagattatattcataataactgggccgcatttgaacgttttattacagcgtttccagacattgaaagtagcgttctctcccaaaaagcgtacgaggtaaaggttatatatggagatacggattctgtgtttatccgattcaagggtgttagtgttgaggggatagctaaaatcggcgagaaaatggcacatataatttcaacggctctgttttgtcctcctataaagttggagtgtgaaaaaacttttataaaacttttgcttataacaaagaaaaagtacattggggtaatttacggcggaaaggttttaatgaagggagtcgacttggttagaaaaaacaactgtcaatttattaacgattatgcccgcaaacttgtagaactgttgttatatgacgacaccgtctcgcgtgctgcggcggaggcgtcgtgtgtttccattgctgaatggaatagacgggccatgccgtctgggatggccgggtttggacgcataattgcagatgcacatcgccagattacatcacccaaattggatattaataagtttgttatgacggccgagcttagtcgtccaccatccgcctacataaaccgtcgctt

SEQ ID NO: 182 - DNA, 993 bp, Human herpesvirus 3 (VZV), 9625875:71540-75730
cgggagccgccacggcaacaaccagaaatatgagaatatatgacggagcgctttaccatggccttattatgatggcatatcaggcgtacgatgaaaccattgcaacgggtacttttttttatcccgttccggtcaaccctctgtttgcatgtccggaacatttggcatcattgcgtggaatgacaaatgctaggcgggttttggcaaaaatggtaccaccaatccctccttttctgggagccaaccaccacgcaactatacgccaacccgttgcctaccatgtaacgcatagtaagtcggattttaatactcttacatattctcttcttggagggtattttaagtttacaccaatatctcttacacatcaactacgaacgggatttcaccccgggattgcctttaccgtagtgcgccaggatcgctttgccacagagcaacttttatatgccgagcgtgcttctgaatcgtactttgtcggacaaatccaagtacaccatcatgatgctattgggggggtaaactttaccctaacccaacccagagctcacgtggacctgggagtcgggtatacagctgtatgtgccacagcagccctgcgatgccctctcacggatatgggcaatactgcccaaaatctttttttttcacgaggaggagtgccaatgttacatgataacgttaccgaatcgttgcgtcgtataacagcatcggggggtcgcttaaatcccaccgaacccctacccatcttcggcggactacgtcctgctacatcggcaggaattgcacgagggcaagcctctgtgtgtgagtttgtggccatgccggtgtccactgacctacaatattttagaactgcatgcaatcctagaggtcgagcatctggaatgttatatatgggtgaccgtgacgccgacatagaggctataatgtttgatcacacacaatcggatgttgcttatacagatcgagcaactcttaacccatgggcat

SEQ ID NO: 183 - DNA, 1067 bp, Human herpesvirus 4 (EBV), 9625578:c156746-153699
taccagggggccaccgtcatccagcccctgtccggattctacaactccccggttctggtggtggactttgccagcctctacccgagcatcattcaggctcataatctctgttattctaccatgataacgccgggagaagagcacaggctagccggcctgcgcccgggagaagactatgagtccttcaggctcacggggggcgtctaccactttgtaaagaagcacgtgcacgagtccttcttggctagtctgttgacctcctggctggccaagcgcaaggccatcaagaagctgctggcggcctgcgaggatccgcgccaaaggaccatcctcgacaagcagcagctggccatcaagtgcacgtgcaacgccgtctacggcttcaccggggtggccaacggcctctttccctgcctctccatcgccgagacggtgacgctgcagggccgcacgatgttggagcgggccaaggccttcgtggaggccctgagccccgccaacctgcaggccctggccccctccccggacgcctgggcgcccctcaaccccgagggccagcttcgagtcatctacggggacacggactcgctgtttatcgagtgccgggggttttcagagagcgagaccctgcgctttgccgatgccctggccgcccacaccacccggagcctgtttgtggcccccatctccctggaggccgagaagaccttctcctgcctgatgctgattacaaagaagagatatgtgggggtgctgacggacggcaagaccctgatgaagggggtggagctcgtccggaagacggcctgcaagtttgtgcagacacgctgccggcgcgtgctcgacctggtgctggcggatgcccgggtaaaggaggcggccagcctcctctcccaccggcccttccaagagtcatttacacaagggctacctgtgggctttttgcccgtcattgacatcctaaaccaggcctacacagacctccgtgaaggcagggtccccatgggggagctctgcttttcaacggagctcagccgcaagctctcagcctacaagagcacccagat

SEQ ID NO: 184 - DNA, 992 bp, Human herpesvirus 4 (EBV), 9625578:c137466-133321
cgccgacaagcggacagagcagactgttttggtgaacgggctggtggcctttgccttctccgagaggacccgggccgtcacccagtgtctctttcacgccattcctttccatatgttttacggggacccgcgagtggctgccaccatgcaccaggatgttgccacctttgttatgcgcaatcctcagcagcgggccgtggaagccttcaaccggccagagcagctctttgcagagtaccgggagtggcaccgctcgcccatgggcaaatacgcggccgaatgtcttccttccctcgtttcaatcagtggaatgaccgccatgcacatcaagatgtcccccatggcctatattgcccaggccaagctcaagatccacccaggggtggccatgaccgtggtcaggaccgatgagatcctctctgaaaacatattgtttagctccagggcctcaacatccatgttcattgggaccccaaatgttagccgccgggaggccagggtggacgcggtaacctttgaggtgcatcacgagatggcctccatcgacaccgggcttagttatagctcgaccatgactccggccagggtggcggccatcactactgacatgggtatccacacccaagacttctttagcgtctttccggccgaggcctttggcaaccagcaagtcaatgactacatcaaggccaaggtgggcgctcagcgcaatgggacgctgcttcgggaccccaggacatacctggcaggtatgactaatgttaatggagctccaggactctgccacggccagcaggccacctgtgagattatcgtaacaccggtcacggcagacgtggcttattttcaaaagtccaactctccaaggggacgggccgcctgtgtggtctcctgtgaaaactacaatcaggaggttgccgaggggctcatctatgaccattctcgcccggatgccgcctatgaataccggagcactgtgaatccctgggcat

SEQ ID NO: 185 - DNA, 1136 bp, Human herpesvirus 5 (CMV), 9628290:c59588-56550
taccagggcgccacggtgtttgagcccgaggtgggttactacaacgaccccgtggccgtgttcgactttgccagcctctacccttccatcatcatggcccacaacctctgctactccaccctgctggtgccgggtggcgagtaccctgtggaccccgccgacgtatacagcgtcacgctagagaacggcgtgacccaccgctttgtgcgtgcttcggtgcgcgtctcggtgctctcggaactgctcaacaagtgggtttcgcagcggcgtgccgtgcgcgaatgcatgcgcgagtgtcaagaccctgtgcgccgtatgctgctcgacaaggaacagatggcgctcaaagtaacgtgcaacgctttctacggttttaccggcgtggtcaacggtatgatgccgtgtctgcccatcgccgccagcatcacgcgcatcggtcgcgacatgctagagcgcacggcgcggttcatcaaagacaacttttcagagccgtgttttttgcacaatttttttaatcaggaagactatgtagtgggaacgcgggagggggattcggaggagagcagcgcgttaccggaggggctcgaaacatcgtcagggggctcgaacgaacggcgggtggaggcgcgggtcatctacggggacacggacagcgtgtttgtccgctttcgtggcctgacgccgcaggctctggtggcgcgtgggcccagcctggcgcactacgtgacggcctgtctttttgtggagcccgtcaagctggagtttgaaaaggtcttcgtctctcttatgatgatctgcaagaaacgttacatcggcaaagtggagggcgcctcgggtctgagcatgaagggcgtggatctggtgcgcaagacggcctgcgagttcgtcaagggcgtcacgcgtgacgtcctctcgctgctctttgaggatcgcgaggtctcggaagcagccgtgcgcctgtcgcgcctctcactcgatgaagtcaagaagtacggcgtgccacgcggtttctggcgtatcttacgccgcttggtgcaggcccgcgacgatctgtacctgcaccgtgtgcgtgtcgaggacctggtgctttcgtcggtgctctctaaggacatctcgctgtaccgtcaatctaacct

SEQ ID NO: 186 - DNA, 998 bp, Human herpesvirus 5 (CMV), 9628290:c129226-125114
cgcgcagcgtcagggcctgccggactttatctcacgtcagcacgtgctttacaacggctgctgcgtcgtgacggcgcctaagacgttgatcgagtacagcctacccgtacctttccaccgtttctactcaaaccccaccatctgcgcggcgttgagcgacgacattaaacgctacgtgaccgagttcccgcactatcaccgtcacgacggtggtttcccgctacccacagccttcgcgcacgagtaccacaactggctgcgctcgcccttttcgcgttactcggccacctgtcccaacgtgttgcactcagtcatgacgctggccgccatgttatacaaaatctcaccagtttcactggtgctgcagaccaaggcgcacatccacccgggattcgcactcacggccgtacgcaccgacaccttcgaggtggacatgctgctctacagcggcaaatcatgcacgtcagttatcatcaacaaccctatcgtgaccaaggaggaacgcgacatcagcactacgtaccacgtcacgcagaacattaacaccgtagacatgggtctgggttacacgtcaaatacctgcgtagcctacgtaaaccgcgtgcgaaccgacatgggcgtccgcgtgcaggacctctttcgcgtcttccctatgaacgtgtaccggcacgacgaggtggaccgctggatccggcacgcggccggcgtagaacggccgcaactgttagacacggagaccatctctatgctgacgttcggcagcatgtccgagcgcaatgccgccgccacggtgcacggacaaaaggccgcgtgcgaactaatccttacgccggtgacgatggacgttaattactttaagatccccaacaacccgcgcgggcgtgcctcctgcatgctggccgtcgatccgtacgacacggaggccgccaccaaggccatctacgaccatcgcgaagcggacgcacagactttcgcggccacacacaacccctgggcct

SEQ ID NO: 187 - DNA, 1058 bp, Human herpesvirus 6 (Roleola), 9628290:c59588-56550
tacaaaggggctaccgttttggagcctaagacgggttattatgctgtgcctaccgtggtgtttgattttcaaagtttgtatccgagcattatgatggcgcataatctgtgttatagtactttagttttggatgaacgacagatagctggattgtcagagagtgacatcttaaccgtgaagttgggggatgagactcatcggtttgtgaagccttgtatccgtgagtctgtgcttgggagtctactaaaggactggctggccaagagacgagaagtgaaggcggagatgcagaactgttcggatccgatgatgaaacttcttctggataaaaagcagctcgctctgaaaacaacatgtaactcggtgtacggtgtcacgggagcggcgcacgggttattgccgtgtgttgcgattgctgcttctgtaacgtgtcttggaagagagatgctttgttccacggtggattatgttaattccaagatgcagtccgagcaatttttttgcgaggaatttggtttaacgtcatcagattttactggtgatttggaagtggaggtaatttatggtgatacggatagcatctttatgtctgtcagaaatatggttaatcagtctctgcgaaggattgcgccgatgatcgccaaacatatcacagatcgtctgttcaagtcgcctatcaagctcgagtttgaaaagattttatgtccgctaattttgatttgtaaaaaaagatacattggtagacaggatgattcgcttttaatttttaagggggtagatctggtgagaaagacttcttgcgattttgtgaagggtgtggtgaaagatatcgtggacttgttgttctttgatgaagaggttcagactgctgctgtggagttttctcacatgacacagacacagttgcgtgaacaaggagtgcctgtgggtattcataaaattttgcgtcgtctgtgcgaagcgcgggaggagctttttcagaatcgggcagacgtgagacatttaatgttgtcctctgtgctttccaaagaaatggctgcatataagcaaccgaatct

SEQ ID NO: 188 - DNA, 1001 bp, Human herpesvirus 6 (Roleola), 9628290:c93912-89875
cgcgcagcgacacggcaactccgttcattttcaatcactacaacacattctatacaacgggctttgcctgatctcaccgatcaccaccctaagacggtactatcaaccaatcccatttcatcgattcttctccgacccgggaatctgcggcaccatgaatgctgatatccaagttttcctaaatacatttcctcactgtcaaagaaacgacggcggttttcctctcccgcccccattagcattagaattttataattggcaacgaacaccgttttccgtgtactcagccttctgccccaattccctgttgagcattatgacgcttgccgccatgcactcaaaattgtctcccgttgccatagcgatccaaagcaaaaacaaaatccatccgggctttgcggccacactagtccggacggataatttcgacgtcgagtgcctattatacagttccagagcagccacatctataattttagacgatcccacggtcaccgcggaagctaaagatatcgcaaccacttacaacttcacccagcacctaagttttgtagatatgggcttaggttttagctctaccaccgccactgccaatcttaagcgaattaaatcagatatggggagcaagatacaaaaccttttctccgccttcccgatacacgcgtttaccaacgcggacataaatacgtggattcgacatcacgtcgggatagaaaaacctaatccctccgagagcgaagcactaaacatcataacgttcggcggaattaacaaaaacccaccctccatactactgcatggtcaacaagctatctgcgaagttatactgaccccggttacgacaaacattaactttttcaaatcgccccacaacccaagaggcagggaatcatgtatgatgggaacggacccgcacaacgaagaggcggctagaaaagcattgtacgaccacacccaaacagacagcgatacattcgccgcaaccacaaacccttgggcat

SEQ ID NO: 189 - DNA, 1758 bp, Enterovirus (genus), NC_001612
caccaatggcctccctagaagaaaaaggagtttctttcacatccaaattcgtcattgcgtccaccaatgccagcaacatcatagtgccaacggtgtccgactctgatgccatccgccgcagattctatatggactgtgacattgaggtgacagactcatacaagacagatttgggcagattggatgcaggacgggccgccagattatgttctgaaaacaacactgcaaacttcaagcgctgcagcccactggtgtgtgggaaagccattcaactcagagataggaaatccaaggtcagatacagtgtggacacggtggtctccgaactcattagagagtacaataacagatatgctattggtaatacaatcgaagccttgtttcagggtccacctaagtttaggcccattagaatcagtcttgaggaaaagccagccccagatgccattagtgatctcctcgctagtgtggacagtgaggaagtgcgtcaatactgcagagaccaaggctggatcatcccagaaactcccaccaatgtcgagcggcaccttaatagggcggtgttgatcatgcagtccattgccactgtggtagcagttgtttcactggtgtatgttatctacaaattgtttgcagggttccaaggtgcatactctggtgcccctaagcaaacactcaagaaacctatactccgcacagcgacagtgcaaggcccaagtcttgattttgctctctcattgcttaggaggaacatcagacaagtccagacagaccaaggccacttcactatgctaggtgttagagatcgcttggctgtcctcccgcgacactcgcagcctgggaagacaatatgggtagaacacaagcttataaacatcttagatgctgttgagttggtggatgaacaaggggtcaacttagaactgaccctggttactcttgataccaatgagaagttcagagacatcaccaagttcatcccagaaaacattagcgctgccagtgatgccaccctagtgatcaacacagagcacatgccctccatgttcgtgccagtgggtgacgttgtgcaatacggtttcctaaacctcagcggaaaacccacccatcgtaccatgatgtacaactttcccactaaggctggacaatgtggtggagtggtgacatctgttggaaaggttatcggcatacatattggtggcaatggcaggcagggcttttgtgcaggactcaagaggagttattttgccagtgagcaaggagagatccagtgggtcaagcccaataaagagacaggcagactcaacatcaatgggccgactcgcactaagctcgaacccagtgtgttccatgatgtctttgaggggaacaaagaaccagcagtcttgcatagcagagacccacgccttgaagtggactttgagcaggctttattctccaagtatgtagggaacacactgcatgagcctgacgagtacatcaaagaggcggccctccactatgcaaatcagttgaagcaactggacatcaacacttctcaaatgagtatggaggaagcttgctatggtactgagaaccttgaggccattgatctccacaccagcgcgggctacccctacagtgctctgggaataaagaagagagatattttagatcccactaccagagatgtgagtaagatgaaattctatatggacaagtatggccttgaccttccttactctacctatgtcaaggatgagctccgctcgatagata

SEQ ID NO: 190 - DNA, 920 bp, Human coxsackievirus, AF499635
caatgcaaagcccaaagtccctacgatcagagcagcaaaagttcagggcccagtatttgattatgcagttgcaatggcaaagaaaaacatcctgacagccaccacagaaaagggtgaattcacaatgttaggagtacatgatagagttgcagtattgcctacccattcaaacccaggtgaaacaatagttgtgtcaggaaaagaagtgaagatcttggatgcaaagaggctggttgataatgatgaggtcaatcttgaaattactattgtaaccctagacagaaacgaaaagtttagagacatcagaactcacttaccgacccaaatccatgagaccaatgatgcggttttggctgtcaacacctccaaatttccaaatatgtacattccagttggatcagtagttgaacagggaatgttgaaccttggtggcagacccacaaatagaaccctaatgtataactttccaactaaagcagggcagtgtggtggtgtcttaatggccactggcaaagtgattggcatacatgttggtggtaatggatctcacggtttcgcagctgcacttaaaagaagttactttactgaagaacagggtgaaattcaatggatgagaccaagtaaagatgcaggttaccccatgatcaacgcgccatcaaagacgaaattagagccaagtgtcttttttgatgttttcccaggcgagaaagaaccagctgcgttaactaaaaatgatcccagattaaaagttgattttgaagaggctgtgttctctaagtacattgggaataaaatcacagaagttgacgaatacatgagagaggctgttgaccattacgctggtcaattgatgtcccttgacatacccacagaacaaatgtgcttggaagatgccatgtatggcacagatggtcttgagg

SEQ ID NO: 191 - DNA, 1277 bp, Echovirus (subgroup), NC_003986
cacttgccagaaggttccactttgatatgaacatcgaggtgatctccatgtatagccagaatgggaagattaacatgcccatgtctgtcaaaacatgtgatgaggattgctgcccggtcaatttcaagaaatgctgcccgctggtgtgtggtaaggccattcaatttattgacagaaagacccaagttaggtattcactggacatgttggtcaccgagatgttcagggagtacaaccacagacacagcgtgggtgccaccctcgaggctttgttccaagggccaccggtctacagggagattaagatcagtgtcgctccagaaacaccccctccaccagcaatcgctgacctgctaaaatcagtagacagtgaggcagtaagggagtactgcaaggaaaaaggctggcttgtgccggaaattagctccaccctacagattgagaagcacgtcagtagagcatttatctgcctacaggctctgactacatttgtctcagtagctggcataatctacattatctacaaattgtttgccggttttcagggcgcgtatacggggatgccaaatcagaaacccaaggtgcccactctgagacaggctaaggtgcagggcccggcattcgagttcgccgtggcgatgatgaagagaaacgccagcacagtgaaaacagaatatggtgagttcaccatgctcggcatctatgacagatgggcagtgttaccacgccacgccaagcccggaccgaccatcttaatgaatgatcaggaggtcggtgtgctagatgccaaagaattggttgacaaagatgggacaaatctggagttgactctcctaaagctcaatcgcaatgagaagtttagggatatcagagggtttctggcaagagaagaagctgaggtgaatgaggctgttttggcaataaacacaagcaagttccccaacatgtacatacccgtaggtcaagtcaccgactacggttttctgaacttgggaggaacgcccacaaagaggatgctcatgtacaatttcccaactagagcaggccaatgtggcggtgtcctcatgtcaacagggaaggttctaggaatacatgtaggcggaaatggacaccaaggattctctgctgccctccttagacattacttcaatgaggaacaaggtgagatagaattcattgagagctcaaaggacgcaggcttccctgtgatcaacacccccagcaaaaccaagctggaaccaagcgtgtttcaccaggtgtttgagggcaacaaagag

SEQ ID NO: 192 - DNA, 1226 bp, Poliovirus (subgroup), NC_002058
tggatagtcaacatcaccagccaggttcaaacagaaaggaacatcaacagggcaatgacaattctacaagcggtgacaaccttcgccgcagtggctggagttgtctatgtcatgtataaactgtttgctggacaccagggagcatacactggtttaccaaacaaaaaacccaacgtgcccaccattcggacagcaaaggtacaaggaccagggttcgattacgcagtggctatggctaaaagaaacattgttacagcaactactagcaagggagagttcactatgttaggagtccacgacaacgtggctattttaccaacccacgcttcacctggtgaaagcattgtgatcgatggcaaagaagtggagatcttggatgccaaagcgctcgaagatcaagcaggaaccaatcttgaaatcactataatcactctaaagagaaatgaaaagttcagagacattagaccacatatacctactcaaatcactgagacaaatgatggagtcttgatcgtgaacactagcaagtaccccaatatgtatgttcctgtcggtgctgtgactgaacagggatatctaaatctcggtgggcgccaaactgctcgtactctaatgtacaactttccaaccagagcaggacagtgtggtggagtcatcacatgtactgggaaagtcatcgggatgcatgttggtgggaacggttcacacgggtttgcagcggccctgaagcgatcatacttcactcagagtcaaggtgaaatccagtggatgagaccttcgaaggaagtgggatatccaatcataaatgccccgtccaaaaccaagcttgaacccagtgctttccactatgtgtttgaaggggtgaaggaaccagcagtcctcactaaaaacgatcccaggcttaagacagactttgaggaggcaattttctccaagtacgtgggtaacaaaattactgaagtggatgagtacatgaaagaggcagtagaccactatgctggccagctcatgtcactagacatcaacacagaacaaatgtgcttggaggatgccatgtatggcactgatggtctagaagcacttgatttgtccaccagtgctggctacccttatgtagcaatgggaaagaagaagagagacatcttgaacaaacaaaccagagacactaaggaaatgcaaaaactgctcgacacatatggaatcaacctcccactggtgacttatgt

SEQ ID NO: 193 - DNA, 436 bp, Polio type 1 Sabin , AY184219:162-597
caagcacttctgtttccccggtgatgttgtatagactgcttgcgtggttgaaagcgacggatccgttatccgcttatgtacttcgagaagcccagtaccacctcggaatcttcgatgcgttgcgctcagcactcaaccccagagtgtagcttaggctgatgagtctggacatccctcaccggtgacggtggtccaggctgcgttggcggcctacctatggctaacgccatgggacgctagttgtgaacaaggtgtgaagagcctattgagctacataagaatcctccggcccctgaatgcggctaatcccaacctcggggcaggtggtcacaaaccagtgattggcctgtcgtaacgcgcaagtccgtggcggaaccgactactttgggtgtccgtgtttccttttattttattgtggctgcttatggtgacaatc

SEQ ID NO: 194 - DNA, 437 bp, Polio type 2 Sabin, AY184220:162-598
caagcacttctgtttccccggtgacattgcatagactgctcacgcggttgaaagtgatcgatccgttacccgcttgtgtacttcgaaaagcctagtatcgccttggaatcttcgacgcgttgcgctcagcacccgaccccggggtgtagcttaggctgatgagtctggacattcctcaccggtgacggtggtccaggctgcgttggcggcctacctatggctaacgccataggacgttagatgtgaacaaggtgtgaagagcctattgagctacataagagtcctccggcccctgaatgcggctaatcctaaccacggaacaggcggtcgcgaaccagtgactggcttgtcgtaacgcgcaagtctgtggcggaaccgactactttgggtgtccgtgtttcctgttatttttatcatggctgcttatggtgacaatc

SEQ ID NO: 195 - DNA, 437 bp, Polio type 3 Sabin, AY184221:164-600
caagcactactgtttccccggtgaggccgcatagactgttcccacggttgaaagtgtccgatccgttatccgctcatgtacttcgagaagcctagtatcgctctggaatcttcgacgcgttgcgctcagcactcaaccccggagtgtagcttgggccgatgagtctggacagtccccactggcgacagtggtccaggctgcgctggcggcccacctgtggcccaaagccacgggacgctagttgtgaacagggtgtgaagagcctattgagctacatgagagtcctccggcccctgaatgcggctaattctaaccatggagcaggcagctgcaacccagcagccagcctgtcgtaacgcgcaagtccgtggcggaaccgactactttgggtgtccgtgtttccttttattcttgaatggctgcttatggtgacaatc

SEQ ID NO: 196 - DNA, 1854 bp, Paramyxoviridae morbillivirus (Rubeola), AY523581
atgtcaccacaacgagaccggataaatgccttctacaaagataacccccatcccaagggaagtaggatagttattaacagagaacatcttatgattgatagaccttatgttttgctggttgttctattcgtcatgtttctgagcttgatcgggttgctagccattgcaggcatcagacttcatcgggcagccatctacaccgcagagatccataaaagcctcagcaccaacctagatgtaactaactcaatcgagcatcaggtcaaggacgtgctgacaccactcttcaaaatcatcggtgatgaggtgggcctgagaacacctcaaagattcactgacctagtgaaattcatctctgacaagattaaattcctcaatccggatagggagtacgacttcagagatctcacttggtgtatcaacccgccagagagaatcaaattggactatgatcaatactgtgcagatgtggctgctgaagagctcatgaatgcattggtgaactcaactctactggagactaggacaaccaatcagttcctagctgtctcaaagggaaactgctcagggcccactacaatcagaggtcaatcctcaaacatgtcgctgtccctgttagacttgtatttaagtcgaggttacaatgtgtcatctatagtcactatgacatcccagggaatgtacgggggaacttacctagtggaaaagcctaatctgagcagcaaagggtcagagttgccacaaccaagcatgcaccgagtgtttgaagtgggtgtcatcagaaatccgggtttgggggctccggtgttccacatgacaaactatcttgagcagccagtcaacaatgatttcagcaactgcatggtggctttgggggagctcaaactcgcagctctttgccacggggaagattctatcacaattccctatcagggatcagggaaaggtgtcagcttccagctcgtcaagctaggcgtctggaaatccccaaccgacatgcaatcctgggtccccttatcaacggatgatccagtgatagacaggctttacctctcatctcacagaggtgttatcgctgacaatcaagcaaaatggggtgtcccgacaacacgaacagatgacaagttgcgaatggagacatgcttccagcaggcgtgtaagggtaaaatccaagcactctgcgagaatcccgagtgggcaccattgaaggataacaggattccttcatacggggtcttgtctgttgatctgagtctgacagttgagcttaaaatcaaaattgcttcaggattcgggccattgatcacacacggttcagggatggacctatacaaatccaaccacaacaatgtgtattggctgactatcccgccaatgaagaacctagccttaggtgtaatcaacacattggagtggattccgggattcaaggttagtcccaacctctttactgtcccaattaaggaagcaggcgaggactgccatgctccaacatacctacctgcggaggtggatggtgatgtcaaactcagttccaatctggtgattctacctggtcgagatctccaatatgttttggcaacctacgatacttccagggttgaacatgctgtggtttattacgtttacagcccaagccgctcattttcttacttttatccttttaggttgcctataaagggagtccccatcgaattacaagtggaatgcttcacatgggaccaaaaactctggtgccgtcacttctgtgtgcttgtagactcagaatctggcggacatatcactcactctgggatggtgggcatgggagtcagctgcacagccactcgggaggatggaaccaatcgcggatag

SEQ ID NO: 197 - DNA, 1008 bp, Paramyxoviridae morbillivirus (Rubeola), 9626945:3438-4445
atgacagagatctacgatttcgacaagtcggcatgggacatcaaagggtcgatcgctccgatacaacctaccacctacagtgatggcaggctggtgccccaggtcagagtcatagatcctggtctaggtgataggaaggatgaatgctttatgtacatgtttctgctgggggttgttgaggacagcgatcccctagggcctccaatcgggcgagcattcgggtccctgcccttaggtgttggtagatccacagcaaaacccgaggaactcctcaaagaggccactgagcttgacatagttgttagacgtacagcagggctcaatgaaaaactggtgttctacaacaacaccccactaaccctcctcacaccttggagaaaggtcctaacaacagggagtgtcttcaatgcaaaccaagtgtgcaatgcggttaatctaataccgctggacaccccgcagaggttccgtgttgtttatatgagcatcacccgtctttcggataacgggtattacaccgttcccagaagaatgctggaattcagatcggtcaatgcagtggccttcaacctgctagtgacccttaggattgacaaggcgattggccctgggaagatcatcgacaatgcagagcaacttcctgaggcaacatttatggtccacatcgggaacttcaggagaaagaagagtgaagtctactctgccgattattgcaaaatgaaaatcgaaaagatgggcctggtttttgcacttggtgggatagggggcaccagtcttcacattagaagcacaggcaaaatgagcaagactctccatgcacaactcgggttcaagaagaccttatgttacccactgatggatatcaatgaagaccttaatcggttactctggaggagcagatgcaagatagtaagaatccaggcagttttgcagccatcagttcctcaagaattccgcatttacgacgacgtgatcataaatgatgaccaaggactattcaaagttctgtag

SEQ ID NO: 198 - DNA, 1734 bp, Newcastle disease, AY510092
atggaccgcgccgttagccaagttgcgttagagaatgatgaaagagaggcaaaaaatacatggcgcttgatattccggattgcaatcttattcttaacagtagtgaccttggctatatctgtagcctcccttttatatagcatgggggctagcacacctagcgatcttgtaggcataccgactaggatttccagggcagaagaaaagattacatctacacttggttccaatcaagatgtagtagataggatatataagcaagtggcccttgagtctccgttggcattgttaaaaactgagaccacaattatgaacgcaataacatctctctcttatcagattaatggagctgcaaacaacagcgggtggggggcacctatccatgacccagattatataggggggataggcaaagaactcattgtagatgatgctagtgatgtcacatcattctatccctctgcatttcaagaacatctgaattttatcccggcgcctactacaggatcaggttgcactcgaataccctcatttgacatgagtgctacccattactgctacacccataatgtaatattgtctggatgcagagatcactcacattcatatcagtatttagcacttggtgtgctccggacatctgcaacagggggggtattcttttctactctgcgttccatcaacctggacgacacccaaaatcggaagtcttgcagtgtgagtgcaactcccctgggttgtgatatgctgtgctcgaaagtcacggagacagaggaagaagattataactcagctgtccctacgcggatggtacatgggaggttagggttcgacggccagtaccacgaaaaggacctagatgtcacaacattattcggggactgggtggccaactacccaggagtagggggtggatcttttattgacagccgcgtatggttctcagtttacggagggttaaaacccaattcacccagtgacactgtacaggaagggaaatatgtgatatacaagcaatacaatgacacatgcccagatgagcaagactaccagattcgaatggccaagtcttcgtataagcctggacggtttggtgggaaacgcatacagcaggctatcttatctatcaaggtgtcaacatccttaggcgaagacccggtactgactgtaccgcccaacacagtcacactcatgggggccgaaggcagaattctcacagtagggacatctcatttcttgtatcaacgagggtcatcatacttctctcccgcgttattatatcctatgacagtcagcaacaaaacagccactcttcatagtccttatacattcaatgccttcactcggccaggtagtatcccttgccaggcttcagcaagatgccccaacccgtgtgttactggagtctatacagatccatatcccctaatcttctatagaaaccacaccttgcgaggggtattcgggacaatgcttgatggtgtacaagcaagacttaaccctgcgtctgcagtattcgatagcacatcccgcagtcgcattactcgagtgagttcaagcagtaccaaagcagcatacacaacatcaacttgttttaaagtggtcaagactaataagacctattgtctcagcattgctgaaatatctaatactctcttcggagaattcagaatcgtcccgttactagttgagatcctcaaagatgacggggttagagaagccaggtctggctag

SEQ ID NO: 199 - DNA, 1232 bp, Newcastle disease, 11545722:3256-4487
acgggtagaattggagtgccccaattgtgccaagatggactcatctaggacaattgggctgtactttgattctgcccattcttctagcaacctgttagcatttccgatcgtcctacaagacacaggagatgggaagaagcaaatcgccccgcaatataggatccagcgccttgacttgtggactgatagtaaggaagactcagtattcatcaccacctatggattcatctttcaagttgggaatgaagaagccactgtcggcattatcgatgataaacccaagcgcgagttactttccgctgcgatgctctgcctaggaagcgtcccaaataccggagaccttattgagctggcaagggcctgtctcactatgatggtcacatgcaagaagagtgcaactaatactgagagaatggttttctcagtagtgcaggcaccccaagtgctgcaaagctgtagggttgtggcaaacaaatactcatcagtgaatgcagtcaagcacgtgaaagcgccagagaagatccccgggagtggaaccctagaatacaaggtgaactttgtctccttgactgtggtaccgaagaaggatgtctacaagatcccagctgcagtattgaagatttctggctcgagtctgtacaatcttgcgctcaatgtcactattaatgtggaggtagacccgaggagtcctttggttaaatctctgtctaagtctgacagcggatactatgctaacctcttcttgcatattggacttatgaccaccgtagataggaaggggaagaaagtgacatttgacaagctggaaaagaaaataaggagccttgatctatctgtcgggctcagtgatgtgctcgggccttccgtgttggtaaaagcaagaggtgcacggactaagcttttggcacctttcttctctagcagtgggacagcctgctatcccatagcaaatgcttctcctcaggtggccaagatactctggagtcaaaccgcgtgcctgcggagcgttaaaatcattatccaagcaggtacccaacgcgctgtcgcagtgaccgctgaccacgaggttacctctactaagctggagaaggggcacacccttgccaaatacaatccttttaagaaataagctgcgtctctgagattgcgctccgcccactcacccagatcatcatgacacaaaaaactaatctgtcttgattatttacagttagtttacctgtccatcaagt

SEQ ID NO: 200 - DNA, 1504 bp, West Nile Virus, AF346319
ttcaactgccttggaatgagcaacagagacttcttggaaggagtgtctggagcaacatgggtggatttggttctcgaaggcgacagctgcgtgactatcatgtctaaggacaagcctaccatcgatgtgaagatgatgaatatggaggcggccaacctggcagaggtccgcagttattgctatttggctaccgtcagcgatctctccaccaaagctgcgtgcccgaccatgggagaagctcacaatgacaaacgtgctgacccagcttttgtgtgcagacaaggagtggtggacaggggctggggcaacggctgcggattatttggcaaaggaagcattgacacatgcgccaaatttgcctgctctaccaaggcaataggaagaaccatcttgaaagagaatatcaagtacgaagtggccatttttgtccatggaccaactactgtggagtcgcacggaaactactccacacaggttggagccactcaggcagggagattcagcatcactcctgcggcgccttcatacacactaaagcttggagaatatggagaggtgacagtggactgtgaaccacggtcagggattgacaccaatgcatactacgtgatgactgttggaacaaagacgttcttggtccatcgtgagtggttcatggacctcaacctcccttggagcagtgctggaagtactgtgtggaggaacagagagacgttaatggagtttgaggaaccacacgccacgaagcagtctgtgatagcattgggctcacaagagggagctctgcatcaagctttggctggagccattcctgtggaattttcaagcaacactgtcaagttgacgtcgggtcatttgaagtgtagagtgaagatggaaaaattgcagttgaagggaacaacctatggcgtctgttcaaaggctttcaagtttcttgggactcccgcagacacaggtcacggcactgtggtgttggaattgcagtacactggcacggatggaccttgcaaagttcctatctcgtcagtggcttcattgaacgacctaacgccagtgggcagattggtcactgtcaacccttttgtttcagtggccacggccaacgctaaggtcctgattgaattggaaccaccctttggagactcatacatagtggtgggcagaggagaacaacagatcaatcaccattggcacaagtctggaagcagcattggcaaagcctttacaaccaccctcaaaggagcgcagagactagccgctctaggagacacagcttgggactttggatcagttggaggggtgttcacctcagttgggaaggctgtccatcaagtgttcggaggagcattccgctcactgttcggaggcatgtcctggataacgcaaggattgctgggggctctcctgttgtggatgggcatcaatgctcgtgataggtccatagctctcacgtttctcgcagttggaggagttctgctcttcctctccgtgaacgtgcacgctg

SEQ ID NO: 201 - DNA, 917 bp, West Nile Virus, AF208017
ggctgctgctttatttccaccgtagagacctgagattgatggccaacgccatctgttccgctgtgcctgtcaactgggttcccacagggcgtaccacttggtcgatccacgcaaaaggagaatggatgacgacggaagacatgctcgcagtctggaacagagtgtggattgaggagaatgagtggatggaagacaaaacaccagttgagaggtggagtgatgttccatactctggaaagagagaagacatttggtgtggcagtttgatcggcacacgaacccgcgccacttgggctgaaaatatccatgtggcaatcaatcaggtccgttcagtgattggagaagagaagtatgtggattacatgagctccttgaggaggtatgaagacaccattgtagtggaggacactgttttgtaaaaaataaagctgtattgagtagttgtatagttgtagtgttcatagcaatttgaattatgattaattatttaggcttaagatagtactatagttagtttagtgtaaataggatttattgagaatggaagtcaggccagattaatgctgccaccggaagttgagtagacggtgctgcctgcggctcaaccccaggaggactgggtgaccaaagctgcgaggtgatccacgtaagccctcagaaccgtctcggaaggaggaccccacgtgctttagcctcaaagcccagtgtcagaccacactttaatgtgccactctgcggagagtgcagtctgcgatagtgccccaggtggactgggttaacaaaggcaaaacatcgccccacgcggccataaccctggctatggtgttaaccagggagaagggactagtggttagaggagaccccacgttaaaaagtgcacggcccaacttggctgaagctgtaagccaagggaagga

SEQ ID NO: 202 - DNA, 432 bp, West Nile virus; identical to SEQ ID NO: 26

SEQ ID NO: 203 - DNA, 1547 bp, Yellow Fever, AY359908
ctgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggactaccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaagagagagctcaagtgcggagatggtatcttcatatttagagact

SEQ ID NO: 204 - DNA, 1035 bp, Yellow Fever, AF013417
aagctgtcagagtttggaaaggcgaagggaagccgtgccatctggtacatgtggctgggagctcgatatcttgagtttgaagccctgggattcctgaatgaggaccactgggcatccagggagaactcagggggaggggttgaaggtatcggtctacaatatctaggctacgtgatcagggacctggctgcactagagggtggtggattctatgcggatgacacagctggatgggacacacgcataacagaggcggatctggatgatgaacaggaaatcttgaactacatgagcccacaccataggaagttggcgctggctgtaatggaaatgacatacaaaaacaaagtggtgaaagtcctgaggccagctccaggtgggaaagcttacatggatgtcataagccggcgggaccagagaggatccgggcaggtggtgacttacgccttgaacaccatcaccaacctgaaggttcaactgattaggatggcggaggcagagatggtgatacaccaccagcatgtccaggactgtgacgacacggttttgaccaagcttgaagcatggctcgctgagcatggctgcgacaggctcaagaggatggcagtgagtggagatgactgtgttgtccgacccattgatgacaggtttggcctggctctgtcccatcttaatgccatgtcaaaggtgcgaaaagacatatctgaatggcagccatcaaaaggatgggatgactgggagaatgtgcccttctgctctcaccactttcatgaactgcaactgaaggatggcaggagaattgtagtgccttgccgggatcaagatgagctggttggcagagggagagtgtctccaggaaatggttggatgatcaaggagacagcatgccttagcaaggcctacgccaacatgtggtcactgatgtactttcacaagagggacatgaggctgctttcactggctgtttcttctgctgttcccacatcttgggttccacagggacgcaccacgtggtctgttcatgggaagggagag

SEQ ID NO: 205 - DNA, 762 bp, Variola major virus, 623595:183809-184570
atgaaacaatatatcgtcctggcatgcatgtgcctggcggcagctgctatgcctgccagtcttcagcaatcctcatcctcgtgtactgaagaagaaaacaaacattatatgggaatcgatgttattatcaaagtcacaaagcaagaccaaacaccgaccaatgataagatttgccaatccgtaacggaaattacagagtccgagtcagatcccgaggtggaatcagaagatgattccacatcagtcgaggatgtagatcctcctaccacttattactccattattggcggaggtctgagaatgaactttggattcaccaaatgtcctcagattaaatccatctcagaatccgctaatggaaacgcagtgaatgctagattgtccagtgtgcccccaggacaaggtaaggactctcccgctatcactcgtgcagaagctctggctatgatcaaagactgtgagctgtctatcgacattagatgtagcgaagaagagaaagacagcgacatccagacccatccagtactcgagtctaacatctctcataagaaagtgagttacgaagatatcatcggttcaacgatcgttgatacaaaatgcgtcaagaatctagagtttagtgttcgtatcggagacatgtgcaaggaatcgtctgatcttgaggtcaaggatggatttaagtatgtcgacggatcggtatctgaaggtgtaaccgatgatacttcactcatcgattcaacaaaactcaaatcgtgtgtctga

SEQ ID NO: 206 - DNA, 942 bp, Variola major virus, 623595:151032-151973
atgacacgattgtcaatacttttgttactaatatcattagtatactctacaccttatcctcagatacagatatctaaaaaaataggtgatgatgcaactctatcatgtagtagaaataatataaatgattatgttgttatgagtgcttggtataaggagcccaattccattattcttttagctgccaaaagtgacgtcttgtattttgataattataccaaggataaaatatcatacgattctccatacgatgatctagttacaactattacaattaaatcattgactgctaaagatgccggtacttatgtatgtgcattctttatgacatcaactacaaatgatactgataaagtagattatgaagaatactctacagagttgattgtaaacacagatagtgaatcgactatagacataatactatctggatcttcacattcaccggaaactagttctgagaaacctgattatataaataattttaattgctcgttggtatttgaaatcgcgactccgggaccaattactgataatgtagaaaatcatacagacactgtcacatacactagtgatatcattaatacagtaagtacatcatctggagaatccacaacagacaagacgtcgggaccaattactaataaagaagatcatacagtcacagacactgtctcatacactacagtaagtacatcatctgaaattgtcactactaaatcaaccgccaatgatgcgcacaatgataatgaaccatctactgtgtcgccaacaactgtaaaaaacatcacgaaatctataggtaagtatagtactaaagactatgtcaaagtatttggtattgcagcattaattatattgtcggccgtggcaattttctgtattacgtattatatatgtaataaacgttcacgtaaatacaaaacagaaaacaaagtctag

SEQ ID NO: 207 - DNA, 378 bp, Variola major virus, 623595:144137-144514
atggctgtttgtataatagaccacgataatatcagaggagttatttactttgaaccagtccatggaaaagataaagttttaggatcagttattggattaaaatccggaacgtataatttgataattcatcgttacggggatattagtcgaggatgtaattccataggcagtccagaaatatttatcggtaacatctttgtaaacagatatggtgtagcatatgtttatttagatacagatgtaaatatatctacaattattggaaaggcgttatctatttcaaaaaatgatcagagattagcgtgtggagttattggtatttcttacataaatgaaaagataatacattttcttacaattaacgagaatggcgtttga

SEQ ID NO: 208 - DNA, 291 bp, Variola major virus; identical to SEQ ID NO: 49

SEQ ID NO: 209 - DNA, 812 bp, Monkeypox virus, U84503
gtgaatgccgtggaaatgctacagagattacaatctagaatctcagatcttgaaatacagttgaacgactgcggacgtaataatgaaatcaatgctgatatggaaaagagatagaatcatggatcttgatagacatcttaacgattgtaaaaacggtaacggagcatcttctgaggaggtaaataggctaaagactagaatcagggatcttgaacgatcgctagagatcttctcaaaggatgaatcagaactctattcggcatataaaactgaactcggtaatgccagggaacaaattagtaacttgcaagaaagtctacgtagagagcgtgaatctgacaaaactgatagttactataggagggaattgactcgcgaaagaaataaaatcgtagaattgaaaaaaagaacttaataagtgtttcgatgccaatcatgacaagtacatcgacgaaatccattccaagaaaacacgtatttctgatctcgaacgacaactaacagcctgtaaatctaatgtggtgtagcaatggagacatggaccgatacaaactggaaattgaatctcttaaacgtgagctcgtcgagtacagacgtggtaacaatggatcccatagtgattgtaagtactatgacgaagaagcaagagaggaagttagttaagagattgcgtcaagagctgactcaattacatgaagatcttaaacgtgtcagggaatcagataaaaatgatagtactacaagagagagcttgatgaaacaacgtgctaaagttattgaggtcgaaaaggagctggaacgatatttcgacg

SEQ ID NO: 210 - DNA, 800 bp, Reston Ebola, 22789222:11464-18866
agttggacaatagggagtggtgtcccctatatagggtcaagaaccgaggataaaatcggacagcctgctatcaagccgcgatgcccttcatctgccctcaaggaggctatagaattagcatcaaggctcacttgggttacacaaggaggttctaatagtgaacaattaatccggcctttcttggaagcgagagtcaaccttagtgtcagtgaagtcctgcaaatgacaccatcacattattcaggaaatattgtccatcgatataacgaccaatacagcccgcactcatttatggcgaatcgcatgagcaatactgcgacccgtctcatagtgtcaactaatacacttggagaattttcaggtggagggcaggccgccagggatagcaatataattttccagaatgttataaatttagcagttgccctttatgatattagattccggaatacaaacacctctgatataaggcataatagggctcatcttcacctgacagagtgctgtactaaagaggtcccggcccagtatttgacatatacaagtgcacttaatctggatttaagccgttatcgtgataatgaactaatatatgactcaaatccactgaagggaggattgaactgcaatttaacaatagatagtcctttagtgaagggtcctaggcttaacatgattgaagatgatcttctccgctttccacacctttctggatgggagttagcgaaaacggtggtacaatccatcatctcagacaatagcaactcatcaacagatccaatcagtagcggagaaacacg

SEQ ID NO: 211 - DNA, 806 bp, Reston Ebola, 22789222:56-3013
aggagtaagacttcaccctttggcccgaacagccaaagtgcgtaatgaggttaatgcatttaaggccgccctaagctcacttgctaagcatggggaatatgccccttttgctcgccttctcaatctctcgggagttaacaacctagaacatggtctctacccacagttatcagcaattgctcttggagttgccacagcacatggtagcacccttgcaggagttaatgttggtgagcagtatcagcagcttagagaggctgccactgaagctgagaagcaactccaacaatatgctgagtccagagaactcgacagcctaggcctggacgatcaggaaagaagaatactaatgaacttccatcagaagaaaaacgaaattagtttccagcagaccaatgcaatggtaacccttaggaaagagcgactggctaaattaacagaagctataacgctggcctcaagacctaacctcgggtctagacaagacgacggcaatgaaataccgttccctgggcctataagcaacaacccagaccaagatcatctggaggatgatcctagagactccagagacaccatcattcctaatggtgcaattgaccccgaggatggtgattttgaaaattacaatggctatcatgatgatgaagttgggacggcaggtgacttggtcctgttcgatcttgacgatcatgaggatgacaataaagcttttgagccacaggacagctcgccacaatcccaaagggaaatagagagagaaagattaattcatccacccccaggcaacaacaaggacgacaatc

SEQ ID NO: 212 - DNA, 1498 bp, Reston Ebola, 22789222:4396-5893
gatgaagattaagaaaaaccagtcggtattttccagacttggcatttcttatcttcatcttctaaagtgagatattttatcatcaaaaaatgaggcgcggagtgttaccaacggctcctccagcatataatgatattgcataccctatgagcatactcccaacccgaccaagtgtcatagtcaatgagaccaaatcagatgtactggcagtgccaggggcagatgttccatcaaactccatgagaccagtggctgatgataacattgatcactcaagccatactccaagcggagtagcttctgcctttatattggaagctacagtgaatgtaatttcgggaacaaaagtcctgatgaagcaaatacctatttggcttccactgggtgtagctgatcagaagatatacagctttgattcaacaacagccgcaattatgttggcttcctacacagtgacacacttcgggaagatatctaacccgctggtacgtgtcaacaggctaggcccaggaatacccgatcatccgctacgactcctaaggttgggcaatcaggcattccttcaagagtttgttcttccaccagtccagcttccccagtatttcacatttgatctaacagctctaaagctcatcactcaaccattgccagctgcaacctggacagacgaaactccagcaggagcagtcaatgctcttcgtcctgggctctcactccatcccaagcttcgtccaattctcctgccggggaagacaggaaagaaaggacatgcttcagacttaacatcacctgacaagattcaaacaatcatgaatgcaataccggacctcaaaattgtcccgattgatccaaccaagaacatagttggaattgaggttccagaattactagttcaaaggctgaccggcaaaaaaccacaacccaaaaatggccaaccaattattccagttcttcttccgaaatatgttggacttgatcctatatcgccaggggacttaactatggttatcacccaggattgtgattcatgccactctccagccagccatccgtatcacatggacaagcagaatagttaccaataatttaaattccattcgagctattattctgctagtaattccgacgggatcaatagactaaaaatctgattgtatagaattataaaagaatcaagcagaggcaacagactcacagcttacgcctagataactaatattaaggagttttttaatctaattttccagtcttgagtaataatcatttcttttgtaattaattatgcatttgttaacttatcggtgcgagatttccttgagaacccggcggagcttctactatctgcagtaaccagaagagaagttcaacccagtcaaaactaaaccaagcaatattctgaatgctctatagtctattctaatcagaggtataacaatggctaagatttcaatgactcgttaacaatcgctagtaattttaatctccagattaagaaaaa

SEQ ID NO: 213 - DNA, 1218 bp, Marburg virus, 13489275:11479-18474
gcggcacttaaagaagccattgagatggtttctagattgttgtgggtgactcaaggcactgcagaccgagaaaaattgcttattcctctcctcaattcgagggtaaatctggactatcagacagtgcttaactttttacctacacactactcaggcaacatagttcatagatataatgaccaatatggacaacattcctttatggcaaacaggatgagtaatacatctacacgtgcaattatatcaactaacacactgggcaaatatgctggggggggtcaagctgctgttgatagtaatataatcttccaaaatactatcaatttaggagtggcagttttagatattgcattatctcttgctaaattgtcgtcagcatcaaatgtcactttccgtttgatgttaaataagtgctgcacgcggcatgtgccatctgaatacctattttttgataaacctttagatgtggatttgaacaagtatatggacaatgagttagtttatgacaatgaccctctttgcagtgggattaaagggagattaggcagagtatcccgatcaacactctcgttgagtttgaatgtcagtgacattggttcttatgactttccaactattgctgcatggacactaggagaaactatagtcggaagcattttttctgatgagtcttctcaaagtacagatccaataagttcaggttgcacaaaaactttcgtcacacatttccttgtgtatccagttgagagtattttttatgcattcggggctaacttaatagtagaaagtttaagtctaagtaggatcaaatcaattaagaacctctcagatttgacattccttatatcatccacaatcaggaatttatcacatagatcacttcggattcttcaatctaccttccgacatgaattggtactcacccgactagcccaccacataccgttaatttctttaatgttagggggttctgcaggagagaaaagttcatcagatgctgttcggctatttcttacagcaagttaccagaatttcatcaacaacttcagttgtttgatgaaaaagggccagtcatcactaccggtttggctttactttcctagtgaagggcaacaattaaaacctatattaaaaatcttacagagattatcagacttgttatcacctgacaaagttcaaaagcatcaaatcttagctgacacctgttgtccaattgac

SEQ ID NO: 214 - DNA, 847 bp, Marburg virus, 13489275:103-2190
tcacagaatcaggtgtcacagtcgtttttgaatgaccctacacctgtggaagtaacggttcaagccaggcccataaatcgaccaactgctctgcctcccccagttgacaacaaaattgagcacgaatctacagaagatagctcttcttcaagcagctttgttgatcttaatgatccatttgcgctgctgaatgaggacgaagacactcttgacgacagtgtcatgatcccgagcacaacatcgagagaatttcaagggattccagcaccaccaagacaatctcaggacctcaacaacagccaaggaaagcaggaagatgaatcaacaaatccgattaagaaacagtttctgagatatcaagaactgcctccggttcaagaggatgatgaatcggaatacacaaccgactctcaggagagtatcgaccaaccaggatctgacaatgaacaaggagttgatcttccacctcctccattgtacgctcaggaaaaaaggcaagatccaatacagcacccagcagtaagctctcaggatccctttggcagtattggtgatgtaaatggtgatatcttagaacccataagatcaccttcttcaccatctgctcctcaggaagacacaagggcaagagaagcctatgaattgtcgcctgatttcacaaattatgaggacaatcagcagaattggccacaaagagtggtgacaaagaagggtaggactttcctttatcctaatgatcttctgcagacaaatcctccagaatcacttataacagccctcgtagaggaataccaaaatcctgtctcagctaaggagctccaagcagattggcccgacatgtcatttg

SEQ ID NO: 215 - DNA, 1021 bp, Lassa virus, 23343512:c7122-466
gcatctggctttgtaggattgtgcagaacattgggtagcaaatgtgttcggggaccaaataaagagaatctgtatattaagtccattcagtctctgatttctgatgtcaagggaatcaaattgttgacaaattctaatggcattcaatattggcaagttccgctagaacttagaaatggaagtggaggtgaaagtgtggtcagttatttcagacccttgttatgggattatatgtgcatctccttatcaactgcaatagaactgggtgcatgggtcttaggggaacctaagacagttaaggtgtttgattttttcaaacataacccttgtgactattttcccttaaagccaactgcatcaaaactattggaggatagggttggtttgaatcacatcattcattctttaagaaggctgtacccatcagtgtttgagaaacacatattaccattcatgagcgatctagcgtcaaccaaaatgaagtggtcacccagaataaaatttctagatctctgtgtagcgttggatgttaactgtgaagccttgtctcttgtctcacacatagtaaaatggaaaagagaggaacattacattgtgttatcatctgaattgaggttgtctcacagtaggacacatgaacccatggtggaagaaagagtagtgagcactagtgatgctgttgacaatttcatgaggcaaatttattttgagtcttacgtgagaccatttgttgcgactacaagaacattggggtccttcacgtggtttccacacaagacatcagttccagagggtgaagggttgcatagaatgggtccattttcttcatttgtagagaaagttattcacaaaggtgttgaaaggccaatgtttaagcatgatctgatgatgggttatgcttggatagactttgatattgagccagctagattcaatcaaaatcaattgatcgcatcaggtttagttgatcctaagtttgactcattggaggatttctttgatgccgtagcttcactacctc

SEQ ID NO: 216 - DNA, 751 bp, Lassa virus, 23343509:101-1810
atggagtggtgagagtttgggatgtgaaaaatgcagagttgctcaataatcagttcgggaccatgccaagtctgacactggcatgtctgacaaaacaggggcaggttgacttgaatgatgcagtacaagcattgacagatttgggtttgatctacacagcaaagtatcccaacacttcagacttagacaggctgactcaaagtcatcccatcctaaatatgattgacaccaagaaaagctctttgaatatctcaggttataattttagcttgggtgcagctgtgaaggcaggagcttgcatgctggatggtggcaatatgttggagacaatcaaggtgtcacctcagacaatggatggtatcctcaaatccattttaaaggtcaagaaggctcttggaatgttcatttcagacacccctggtgaaaggaatccttatgaaaacatactctacaagatttgtttgtcaggagatggatggccatatattgcatcaagaacctcaataacaggaagggcctgggaaaacactgtcgttgatctggaatcagatgggaagccacagaaagctgacagcaacaattccagtaaatccctgcagtcggcagggtttaccgctgggcttacctattctcagctgatgaccctcaaggatgcaatgctgcaacttgacccaaatgctaagacctggatggacattgaaggaagacctgaagatccagtggaaattgccctctatcaaccaagttcagg

SEQ ID NO: 217 - DNA, 1476 bp, Lassa virus, 23343509:c3347-1872
atgggacaaatagtgacattcttccaggaagtgcctcatgtaatagaagaggtgatgaacattgttctcattgcactgtctgtactagcagtgctgaaaggtctgtacaattttgcaacgtgtggccttgttggtttggtcactttcctcctgttgtgtggtaggtcttgcacaaccagtctttataaaggggtttatgagcttcagactctggaactaaacatggagacactcaatatgaccatgcctctctcctgcacaaagaacaacagtcatcattatataatggtgggcaatgagacaggactagaactgaccttgaccaacacgagcattattaatcacaaattttgcaatctgtctgatgcccacaaaaagaacctctatgaccacgctcttatgagcataatctcaactttccacttgtccatccccaacttcaatcagtatgaggcaatgagctgcgattttaatgggggaaagattagtgtgcagtacaacctgagtcacagctatgctggggatgcagccaaccattgtggtactgttgcaaatggtgtgttacagacttttatgaggatggcttggggtgggagctacattgctcttgactcaggccgtggcaactgggactgtattatgactagttatcaatatctgataatccaaaatacaacctgggaagatcactgccaattctcgagaccatctcccatcggttatctcgggctcctctcacaaaggactagagatatttatattagtagaagattgctaggcacattcacatggacactgtcagattctgaaggtaaagacacaccagggggatattgtctgaccaggtggatgctaattgaggctgaactaaaatgcttcgggaacacagctgtggcaaaatgtaatgagaagcatgatgaggaattttgtgacatgctgaggctgtttgacttcaacaaacaagccattcaaaggttgaaagctgaagcacaaatgagcattcagttgatcaacaaagcagtaaatgctttgataaatgaccaacttataatgaagaaccatctacgggacatcatgggaattccatactgtaattacagcaagtattggtacctcaaccacacaactactgggagaacatcactgcccaaatgttggcttgtatcaaatggttcatacttgaacgagacccacttttctgatgatattgaacaacaagctgacaatatgatcactgagatgttacagaaggagtatatggagaggcaggggaagacaccattgggtctagttgacctctttgtgttcagtacaagtttctatcttattagcatcttccttcacctagtcaaaataccaactcataggcatattgtaggcaagtcgtgtcccaaacctcacagattgaatcatatgggcatttgttcctgtggactctacaaacagcctggtgtgcctgtgaaatggaagagatga

SEQ ID NO: 218 - DNA, 1588 bp, Machupo virus, 34365535:c7094-465
gtggctgaagcctactgtattggaaagctaaaaaggtcccttggattgatgggctgcggttccaccagtttgagtgaagaattcttccatcagaccatgcagttaaatggtcagattcctagtcacattatgtctgttttggacatggggcaagggatactacataacacttctgatttgtatggattaatcacagagcaatttttgtgttatgcactcgatcttttgtatgatgtaatccctgtgtcatatacctctagtgacgatcagatcactcttatcaagacaccttctctggatatagaagggggttcagatgctgcggagtggctcgagatgatctgcttccatgagtttctgtcatctaaattgaataagtttgtcagccccaagagtgtcatcgggacttttgtcgcagagttcaaatcaagattttttgtcatgggtgaagaaacaccattgctcacaaagtttgttgctgcagctttacacaatgtaaagtgtaaaacacccacacaattgtcagaaactatagataccatctgtgatcaatgcattgcaaatggagtcagcaccaaaatagtgacaagaatatctaagcgagttaaccaattaattagatactccggatatggagagaccccctttggggctattgaagatcaagatgtgaaagactgggtggatggctcaaggggttaccgtctacagagaaagattgaagctatctttcatgatgacaaggaaacctcttttattaggaactgtgccagaaaggtttttaatgatataaagcgtggcagaatatttgaggagaatctgatcaatttgattggtagaggtggtgatgaggccttgactggttttttacagtatgcaggttgcagtgaacaagaagttaatcgcgtgttgaactatagatgggtgaatttatcaagttttggagatcttaggttagttttgaggacaaagttgatgacaagtagaagagttcttgaaagggaggaagtgccaactttaattaaaaccttgcaatccaaactttccagaaacttcacaaaaggagttaagaagatccttgctgagtcaattaataagtcagctttccagtcatccgttgcctcaggttttattgggttctgcaaaagcatgggtagcaagtgcgttagagatgggaaagggggattcttatacataaaagaagtgtattcaggtgtaagtgcttgtacatgtgaaatatgtgcgttaaagcccaagatcatatattgcaacaactcacttaacaaagtgagtcagttttcaaaacctattttgtgggattatttttcattagtcctaacaaatgcatgtgaacttggagagtgggtgttttccacagttaaagagccccaaaagccattggtgttgaacaaccaaaactttttttgggctgtgaagcctaaagtggtgagacaaattgaagaccaactgggaatgaaccatgttctgcaatctataaggagaaattatccagttctttttgacgaacacttgactccatttatgaatgatcttcaggtcagcagaacaatggatagcgggaggctaa

SEQ ID NO: 219 - DNA, 763 bp, Machupo virus, 34365532:c3364-1670
ttgaagaccctgggattccaacagcagagaggtgctggaaatggtgtggttagaatctgggatgtctcagatccatcaaaactgaataatcagtttggttccatgccagctctcacaatcgcttgtatgactgtccagggtggagaaacgatgaatagtgtggtccaagcgttgacatctctgggcctgttatacactgttaaatatccgaatttaaatgaccttgacaagctaactctagagcacgaatgcttgcagatcgtaactaaggacgagagctccatcaacatctctggctataacttcagtctgtcagctgctgtgaaagctggcgcctcaatacttgacggtgggaacatgctggaaacaattagggtcactcctgataatttctccagcttgattaaatcaactctgcaagtcaagcgaaaagaggggatgtttatagacgagaaacctgggaatcgaaatccttatgagaaccttctgtataaattgtgtctctcaggtgacgggtggccttacattggttccagatcacaaattcttgggagatcttgggacaacacaagtgttgatctaacaaagaaacctcaagttggaccgagacaacccgagaaaaacggtcagaatctaagactagcaaacctgactgaaatgcaagaagcagtgattaaagaggctgtaaagaagttagaccccactaatacactgtggcttgacattgaagggcctccaacagaccctgtggaattggcactat

SEQ ID NO: 220 - DNA, 1491 bp, Machupo virus, 34365532:89-1579
atggggcagcttatcagcttctttcaggagattcctgtttttctacaggaagctctgaacatcgctttagtggctgttagtctcatagctgtcatcaaaggcatcattaacctttacaaaagtggtctcttccagttcatcttctttctcctcctagcagggaggtcctgctcggatggcacattcaaaataggcctacacactgagttccagtcagtcacccttaccatgcagagacttttagctaaccattcaaatgagctcccatctctctgcatgcttaacaatagtttttattatatgaggggaggtgtgaacaccttcctgattcgtgtttctgatatttcagtcctcatgaaggagtatgatgtatcaatctatgaaccagaagaccttggaaattgtcttaacaagtctgactcaagctgggctattcattggttctcaaatgctttgggacatgactggcttatggatcctccaatgctatgtagaaacaagacaaagaaggagggatctaacattcaattcaacatcagcaaagctgatgatgccagagtgtatggaaagaagataagaaatggtatgaggcatctcttcaggggcttccatgacccgtgtgaggaagggaaagtgtgctacctgaccatcaatcagtgtggtgaccccagttcctttgactactgtggcgtgaatcatctttccaaatgtcagtttgaccatgtgaacacccttcatttccttgtgagaagtaagacacatctcaactttgagaggtctttgaaagcatttttctcatggtctctgacagactcctcaggaaaggacatgccaggaggttattgtctagaggaatggatgttgatagcagccaaaatgaaatgtttcggaaacactgctgttgctaaatgtaatcaaaatcatgactcagagttctgtgatatgctgaggctattcgactataacaagaatgcaataaagaccctcaatgatgaatcaaagaaagaaatcaatcttctaagccagacagtgaatgccttaatctcagataatttgttaatgaagaataaaattaaagagctaatgagcatcccttattgtaattacacaaagttttggtatgtcaatcataccctgacagggcagcacactcttccaagatgttggttgataaggaatggaagttatcttaacacttctgaattcaggaatgactggattttagagagtgatcacctcatctcagagatgttaagtaaggaatatgctgaaaggcaaggcaaaaccccaatcacattagttgatatttgtttctggagcacaattttcttcacagcatcattgttccttcatctagtcggaatacccacccatcgacacctcaaaggcgaagcctgtcctttgcctcataagctggacagcttcggaggttgtagatgtggcaaatatcccagattgaagaaacccaccatctggcacaaaagacattaa

SEQ ID NO: 221 - DNA, 923 bp, Venezuelan equine encephalitis virus, 9626526:1-7526
gacagcccattcctcagagctttacaacggagcttcccgcagtttgaggtagaagccaagcaggtcactgataatgaccatgctaatgccagagcgttttcgcatctggcttcaaaactgatcgaaacggaggtggacccatccgacacgatccttgacattggaagtgcgcccgcccgcagaatgtattctaagcataagtatcattgcatctgtccgatgagatgtgcggaagatccggacagattgtacaagtatgcaactaagctgaagaaaaattgcaaggaaataactgacaaggaattggacaagaaaatgaaggagctcgccgccgtcatgagcgaccctgacctggaaactgagactatgtgcctccacgacgatgagtcatgtcgctacgaggggcaagtcgctgtttaccaggatgtatacgcagttgacggaccgacaagtctctatcaccaagccaacaagggagttagagtcgcctactggataggctttgacaccaccccttttatgtttaagaacttggctggagcatatccatcatactctaccaactgggccgacgaaaccgtgttaacggctcgtaacataggcctatgcagctccgacgtcatggagcggtcacgtagagggatgtccattcttaggaagaagtatttgaaaccatccaataatgtcctattctctgttggctcgaccatctaccacgagaagagggacttactgaggagctggcacctgccgtctgtatttcacttacgtggcaagcaaaattacacatgtcggtgtgagactatagttagttgcgacgggtacgtcgttaaaagaatagctatcagtccaggcctgtatgggaagccttcaggctatgctgctacgatgcaccgcgagggattcttgtgctgcaaagtgac

SEQ ID NO: 222 - DNA, 1512 bp, Venezuelan equine encephalitis virus, 9626526:7532-11444
ggccacctgctaagaaacctaagagggaggccccgcaaaagcaaaaagggggaggccaagggaagaagaagaagaaccaggggaagaagaaggccaagacggggccgcctaatccgaaggcacagagtggaaacaagaagaagcccaacaagaaaccaggcaagagacagcgcatggtcatgaaattggaatctgacaagacattcccaattatgctggaagggaagattaacggctacgcttgcgtggtcggagggaagttattcaggccgatgcacgtggaaggcaagatcgacaacgacgttctggccgcacttaagacgaagaaagcatccaaatatgatcttgagtatgcagatgtgccacagaacatgcgggccgatacattcaagtacacccatgagaagccccaaggctattacagctggcatcatggagcagtccaatatgaaaatgggcgtttcacggtgccaaaaggagttggggccaagggagacagcggaagacccattctggataatcagggacgggtggtcgctattgtgctgggaggtgtgaatgaaggatctaggacagccctttcagtcgtcatgtggaacgagaagggagtaactgtgaagtatactccggagaactgcgagcaatggtcactagtgaccactatgtgcctgctcgccaatgtgacgttcccatgtgccgaaccaccaatttgctacgacagaaaaccagcagagactttggccatgctcagcgttaacgttgacaacccgggctacgatgagctgctggaagcagctgttaagtgccccggaagaaaaaggagatctaccgaggagctgtttaaggagtataagctaacgcgcccttacatggccagatgcatcagatgtgccgttgggagctgccatagtccaatagcaattgaggcagtgaagagcgacgggcacgacggctatgttagacttcagacttcctcgcagtatggcctggattcctctggcaacttaaagggaaggactatgcggtatgatatgcacgggaccattgaagagataccactacatcaagtgtcactccacacatctcgcccgtgtcacattgtggatgggcatggttattttctgcttgctaggtgcccggcaggggactccatcaccatggaatttaagaaaggttcagtcacacactcctgctcagtgccgtatgaagtgaaatttaatcctgtaggcagagaactctacactcatccaccagaacacggagcagagcaagcgtgccaagtctacgcgcacgatgcacagaacagaggagcttatgtcgagatgcacctcccgggctcagaagtggacagcagtttgatttccttgagcggcagttcagtcaccgtgacacctcctgtcgggactagcgccttggtgaaatgcaagtgcggcggcacaaagatctccgaaaccatcaacaaggcaaaacagttcagccagtgcacaaagaaggagcagtgcagagcatatc

SEQ ID NO: 223 - DNA, 1312 bp, Eastern equine encephalitis virus, 21218484:47-5683
gagatagaagcaacgcaggtcactgacaatgaccatgctaatgctagggcgttttcgcacctagctactaagctcattgagggagaagtggatacagaccaggtgatcctggatattgggagcgcgcctgtaaggcatacgcattccaaacataagtaccactgtatttgcccaatgaagagcgcagaagaccctgacagactctaccgctacgcagacaagcttagaaaaagtgatgtcactgacaaatgtattgcctctaaggccgcggacctgctaacagtaatgtcgacgcctgacgctgagacaccctcgttatgcatgcacactgactcaacttgcaggtaccacggctccgtggccgtatatcaggatgtatatgcagtgcatgcaccgacttccatttactaccaggcgctgaaaggtgtacgaactatctattggatcgggttcgatactacaccgttcatgtataagaacatggcaggcgcctaccctacatacaacacaaattgggccgatgaaagtgtgttggaagccagaaatatagggctgggtagttcagacttgcacgaaaagagtttcggaaaagtatccattatgaggaagaagaaattacaacccactaataaagtaatattttctgtggggtcaactatctatactgaagagagaatactgttacgcagctggcatctacctaatgtctttcatctaaaaggtaaaactagctttacaggcagatgtaacaccatcgtcagctgcgaaggttacgttgtcaagaagattacgctcagtcctgggatttacgggaaagtggataatcttgcttcgaccatgcaccgagagggattcttaagttgcaaggttacagacacgttaagaggggagagggtctctttccccgtgtgtacgtacgtgccagcgacactgtgcgaccagatgaccgggatactggcgactgacgtcagtgtcgatgacgcccagaagctgctggttgggctcaaccagcgaattgtcgtcaatggcagaacacaacgtaacacaaataccatgcagaattacctattaccagtggtagcccaggcgttctcgcggtgccgggaataccgcgcagacctggaagacgaaaaagggctaggggtacgggaacgttccctagtcatgggctgctgctgggctttcaaaactcacaagatcacatccatttacaagagacctgggactcaaactatcaagaaggtgcccgccgtatttaattcctttgtcatcccacaaccaaccagctatgggcctgatataggattgcgtc

SEQ ID NO: 224 - DNA, 975 bp, Eastern equine encephalitis virus, 21218484:7592-11317
cctgactttgaaacaacgagcacctaaccctccagcaggaccgcccgccaaacgcaagaagcctgcgccaagcctaagcctgcgcaggaaaaagaagcgaccaccaccacctgccaagaaacaaaaacgtaaacctaaaccaggcaaacgacagcgaatgtgtatgaagctagagtcagataaaacgtttccaatcatgttgaacggacaggtgaatggttacgcgtgcgtcgtgggtggacgagtgttcaaaccgctgcacgtagaaggcagaatagacaatgagcaactggccgccatcaagctgaagaaggccagcatatatgaccttgagtatggtgatgtgccacaatgcatgaaatcagataccctccagtacaccagtgacaagcctcctggcttttataactggcaccatggagctgtacagtatgagaacaataggttcaccgtaccacggggggtcggtggaaagggtgacagcgggagacctattcttgacaacaaaggtagagtcgtcgcaattgtcctgggtggagtcaacgaaggatccaggacggctctatcagtggtgacatggaaccaaaaaggggttacagtcaaagatacaccagaggggtcagagccatggtcgcttgccactgtcatgtgcgtcctggccaatatcacgtttccatgtgatcaaccaccctgcatgccatgctgttatgaaaagaatccacacgaaacactcaccatgttggaacagaattacgacagccgagcctatgatcagctgctcgatgccgctgtgaaatgtaatgctaggagaaccaggagagatttggacactcatttcacccagtataagctggcacgcccgtatattgctgattgccctaactgtgggcatagtcggtgcgacagccctatagctatagaagaagtcagaggggatgcgcacgcaggagtcatccgcatccagacatcagctat

SEQ ID NO: 225 - DNA, 878 bp, Western equine encephalitis virus, 21238454:25-7428
cgtatgtcaagtcgttacagcggacgtttccacaatttgagatcgaagcaaggcaggtcactgacaatgaccatgccaatgccagagcgttttcgcatgtggcaacaaagctcattgagagcgaagtcgaccgggaccaagttatcttggacattggaagtgcgcccgtcagacatgcacattccaatcaccgctatcattgtatctgccctatgataagcgctgaagacccggacagactacaacggtatgcagaaagacttaagaaaagtgacattaccgacaagaacatagcctctaaggcggcagacctgctggaagtcatgtcaacaccagacgcagagactccatctctgtgtatgcacacagacgccacgtgtaggtactttggaagtgtagcagtataccaagatgtgtacgcagtccatgcaccgacatcaatctaccaccaggcgcttaaaggagttaggacaatttactggataggctttgacacgaccccttttatgtacaaaaacatggcaggttcctaccctacttacaacacgaactgggctgacgagagagtattggaagcacgtaacattggcctcggtaactcagatcttcaggagagcaggcttggaaaactctcaatccttaggaagaagaggctccaacctactaataagatcatattctcggttggttcaacaatctacacagaagatagatcactgttacgtagctggcatcttccaaacgtgttccacttgaaaggaaagtctaacttcacaggtagatgtgggaccattgtcagctgtgaagggtacgtcatcaaaaagataacgatcagcccaggactatacggtaaagttgagaacttggcgtccacaatg

SEQ ID NO: 226 - DNA, 902 bp, Western equine encephalitis virus, 21238454:7473-11183
tgttctaggaggtgcaaatgagggcacgcgtacggcgctttcagtggtcacttggaaccagaaaggggtgaccattagggatacccccgaaggttctgaaccgtggtcactagttacagcgctatgcgtgctttcgaatgtcacgttcccatgcgacaaaccacccgtgtgctattcactgacgccagaacgaacactcgacgtgctcgaagagaacgtcgacaatccaaattacgacacgctgctggagaacgtcttgaaatgtccatcacgccggcccaaacgaagcattaccgatgacttcacactgaccagtccctacctggggttctgcccgtattgcagacactcaacgccgtgtttcagcccaataaaaattgagaacgtgtgggacgaatctgatgatggatcgattagaatccaggtctcggcacaattcggctacaatcaggcaggcactgcggatgtcaccaaattccgttacatgtctttcgaccacgaccatgacatcaaggaagacagtatggagaaaatagctatcagcacatctggaccctgccgtcgtcttggccacaaagggtacttcctgttagctcaatgtcctccaggtgacagtgtaaccgtcagtatcacgagcggagcatctgagaattcatgcaccgtggagaaaaagatcaggaggaagtttgtcggtagagaggagtacttgttcccacccgtccatggaaagctggtaaagtgccacgtttacgatcacttgaaggagacgtctgccgggtacataaccatgcacaggccaggcccacacgcgtataagtcctatctggaggaagcgtcaggcgaagtgtacattaaaccaccttctggcaagaacgtcacctacgaatgtaagtgtggcgact

SEQ ID NO: 227 - DNA, 1359 bp, Nipah virus, 13559808:5008-6366
aggagacaggtatagaacctctctttcagataactggtcaattaaggacagaaattctgtttctcaaatccgctagcctttgtcaaagaggacacaagcaatggagccggacatcaagagtatttcaagtgagtcaatggaaggagtatctgatttcagccctagttcttgggagcatggtgggtatcttgataaggttgaaccagaaattgatgaaaatggcagtatgattccaaaatacaagatctataccccaggagctaacgagaggaaatacaacaactacatgtaccttatatgttacggctttgttgaagatgttgagagaaccccagagacagggaaacgcaagaagatcaggacaattgctgcctaccctctgggtgttggtaagagtgcctctcatccccaagatcttctggaggaactctgttccctcaaagttactgtgagaagaacagctggatcaactgagaaaattgtgtttggatcatctggccctctaaatcacctcgttccgtggaagaaagtactgactagtggttcaatttttaatgcagtcaaggtttgtcggaacgttgatcagatacagcttgacaagcatcaagctctgagaatattttttctcagtatcacaaagctcaatgattctggaatctacatgattccacgaaccatgcttgagttcaggagaaacaatgccattgccttcaatcttctagtgtacttgaagattgatgctgatttatccaaaatggggatccagggaagcctcgataaagatggcttcaaggttgcctccttcatgctacacttggggaactttgtccgtcgtgcagggaagtattactctgttgattattgtaggaggaagattgataggatgaaattgcagttttcactgggttccataggcggactaagtctccacattaagatcaatggtgtaatcagcaaacggctgtttgctcaaatgggattccaaaaaaacctttgtttctctttgatggacatcaatccttggctcaacagattgacctggaacaacagttgtgagatcagccgagtagcagctgtgttgcagccttctattccaagagagttcatgatctatgatgatgtcttcattgacaatacagggagaattctaaagggctaaacagaattcttctaaaatttaatcagtcatgagtttagtaatcatacctagtcataatacatcacacaggactatttacaaaagacagttaaaaaatggaataatcatgtagtagtaattgagaacattattagaatagtataactaaaatgtagtttttttgagtatttgatttaaaattagataactattacaaaaaa

SEQ ID NO: 228 - DNA, 858 bp, Nipah virus, 13559808:56-2297
aggaatctgctctcccagagtctatcagtaaggaagttcatggttgagatcctcatagaagtcaagaaaggaggatctgctaaaggcagagcagtagaaataatctcagacatcggaaactatgtcgaggaaactggtatggcaggattcttcgcaaccatcagattcgggttggagacaaggtatccagcacttgcactcaacgaattccagagtgacctcaacaccatcaaaagcttgatgctactctacagagaaattggcccaagagccccttatatggtgcttcttgaagaatcaattcagactaaatttgcccctggaggttacccattattgtggagctttgccatgggtgtggctactactattgacaggtctatgggggcattgaatatcaatcgtggttatcttgagcctatgtatttcagactaggccaaaaatcagcacgtcaccatgctggaggaattgatcagaacatggcaaatagactgggactaagttcagatcaagttgcagaactcgctgctgcagttcaggaaacatcagcaggaaggcaagagagtaatgttcaggctagagaggcaaaatttgctgcaggaggtgtgctcattggaggcagtgatcaagatatcgatgaaggggaagaacctatagaacagagtggcagacagtcagttaccttcaaaagggagatgagtatttcatcccttgctaacagtgtgccgagcagttctgtgagcacatccggtgggaccagattgactaattcattactaaacctcagatcaagactggctgcaaaagcagcaaaagaagccgcctcatccaatgcaacagatgatccagcaatcagc

SEQ ID NO: 229 - DNA, 1293 bp, Sin Nombre, 558060:52-3474
atagctggacctgttactgccaaggtaccatctacagaaacgactgaaacaatgcaaggaattgcatttgctggggcaccaatgtatagttcattctcaactcttgtgagaaaagctgatcctgaatatgtcttttctccaggtataattgcagaatcaaatcatagtgtttgtgataaaaagacagtgcccctaacatggactgggtttctagcagtttcaggagagatagaaaggataacaggctgtacagttttctgtacattggctggacctggtgccagttgtgaagcatactcagaaacaggaatcttcaacataagctccccaacttgcttggtaaataaagtccaaaaatttagaggttcagaacaaagaattaattttatgtgtcaaagggttgatcaagatgttgtggtttactgtaatggacagaagaaagtcattcttaccaaaaccctagtaataggtcaatgtatctacacatttactagtctgttttcactgatccctggagttgctcattcccttgctgtggagttatgtgttccaggtcttcatggctgggctacaacagcactgcttattactttctgctttggctggcttctcataccaacagttactttaattatactaaaaatcttaaggctattgaccttctcatgctcgcactattctacagaatcaaaattcaaagtcattttagaaagagtcaaggtggagtatcaaaagacaatgggctcaatggtgtgtgacatttgtcaccatgaatgtgagacggcaaaagagctcgaaacacataagaaaagttgcccagaaggtcaatgcccatactgcatgacaataactgagtccactgagagtgcattacaagctcatttttcaatctgtaagctaacgaacaggttccaggaaatcttaaaaaagtcattaaaacgtccagaagtaaggaaaggttgttacaggacattaggagtattccgctacaagagcaggtgctatgttggcttagtatgggggatcctcttgacgacagagctgattatatgggctgctagtgcagatacccctctaatggagtcaggttggtcagatacagcacatggtgtaggtatagtccctatgaaaacagatttagagcttgactttgccttggcctcatcatcttcttatagttatagaagaaagcttgtaaaccctgccaatcaagaggagacactcccttttcatttccagttagataagcaagtagtgcatgcagagatacagaacctagggcattggatggat

SEQ ID NO: 230 - DNA, 639 bp, Sin Nombre, 38371725:43-1329
tcactctccacgaacaacaactcgtgactgccaggcagaagctcaaagatgcagaaagagcggtggaattggaccccgatgatgttaacaaaagcacattacagagcagacgggcagctgtgtctgcattggagaccaaactcggagaacttaagcgggaactggctgatcttattgcagctcagaaattggcttcaaaacctgttgatccaacagggattgaacctgatgaccatctaaaggaaaagtcatcattgagatatggaaatgtccttgatgtaaattccattgacttagaagagccaagtgggcaaacagctgattggaaatccatcggactctacattctaagtttcgcattaccgattattcttaaagccttgtacatgttatctactaggggccgtcaaacaatcaaagaaaacaagggaacaagaattcgattcaaggatgattcatcttatgaagaagtcaatgggatacgtaagccaagacatctgtatgtttctatgccaactgcccagtctacaatgaaagcagatgagattactcccgggaggttccgtacaattgcttgtggattattcccagcccaagtcaaagcaaggaatattatcagtcctgtcatgggtgtgattg

SEQ ID NO: 231 - DNA, 739 bp, Norwalk virus, 9630803:3848-5371
ttctccattatgtcgcgccttacggcctcaccagaattggccgaggttgtggcccaagatttgctagcaccatctgagatggatgtaggtgattatgtcatcagggtcaaagaggggctgccatctggattcccatgtacttcccaggtgaacagcataaatcactggataattactctctgtgcactgtctgaggccactggtttatcacctgatgtggtgcaatccatgtcatatttctcattttatggtgatgatgagattgtgtcaactgacatagattttgacccagcccgcctcactcaaattctcaaggaatatggcctcaaaccaacaaggcctgacaaaacagaaggaccaatacaagtgaggaaaaatgtggatggactggtcttcttgcggcgcaccatttcccgtgatgcggcagggttccaaggcaggttagatagggcttcgattgaacgccaaatcttctggacccgcgggcccaatcattcagatccatcagagactctagtgccacacactcaaagaaaaatacagttgatttcacttctaggggaagcttcactccatggtgagaaattttacagaaagatttccagcaaggtcatacatgaaatcaagactggtggattggaaatgtatgtcccaggatggcaggccatgttccgctggatgcgcttccatgacctcggattgtggacaggagatcgcgatcttctgcccgaattcgtaa

SEQ ID NO: 232 - DNA, 760 bp, Norwalk virus, 9630803:5358-6950
tggtaccggaggttaatgcttctgaccctcttgcaatggatcctgtagcaggttcttcgacagcagtcgcgactgctggacaagttaatcctattgatccctggataattaataattttgtgcaagccccccaaggtgaatttactatttccccaaataatacccccggtgatgttttgtttgatttgagtttgggtccccatcttaatcctttcttgctccatctatcacaaatgtataatggttgggttggtaacatgagagtcaggattatgctagctggtaatgcctttactgcggggaagataatagtttcctgcataccccctggttttggttcacataatcttactatagcacaagcaactctctttccacatgtgattgctgatgttaggactctagaccccattgaggtgcctttggaagatgttaggaatgttctctttcataataatgatagaaatcaacaaaccatgcgccttgtgtgcatgctgtacacccccctccgcactggtggtggtactggtgattcttttgtagttgcagggcgagttatgacttgccccagtcctgattttaatttcttgtttttagtccctcctacggtggagcagaaaaccaggcccttcacactcccaaatctgccattgagttctctgtctaactcacgtgcccctctcccaatcagtagtatcggcatttccccagacaatgtccagagtgtgcagttccaaaatggtcggtgtactctggatgg

SEQ ID NO: 233 - DNA, 300 bp, Dengue virus, 9626681:97-396
atgaatgaccaacggaaaaaggcgagaaacacgcctttcaatatgctgaaacgcgagagaaaccgcgtgtcaactgtacaacagttgacaaagagattctcacttggaatgctgcagggacgaggaccactaaaattgttcatggccctggtggcattccttcgtttcctaacaatcccaccaacagcagggatattaaaaagatggggaacaattaaaaaatcaaaggctattaatgttctgagaggcttcaggaaagagattggaaggatgctgaatatcttaaacaggagacgtaga

SEQ ID NO: 234 - DNA, 498 bp, Dengue virus, 9626681:439-936
tttcatctgaccacacgcaacggagaaccacacatgatcgtcagtagacaagaaaaagggaaaagccttctgtttaagacaaaggacggcacgaacatgtgtaccctcatggccatggaccttggtgagttgtgtgaagacacaatcacgtataaatgtccctttctcaagcagaacgaaccagaagacatagattgttggtgcaactccacgtccacatgggtaacttatgggacatgtaccaccacaggagagcacagaagagaaaaaagatcagtggcgcttgttccacacgtgggaatgggattggagacacgaactgaaacatggatgtcatcagaaggggcctggaaacatgcccagagaattgaaacttggattctgagacatccaggctttaccataatggccgcaatcctggcatacaccataggaacgacgcatttccaaagagtcctgatattcatcctactgacagccatcgctccttcaatgaca

SEQ ID NO: 235 - DNA, 157 bp, Dengue type 1, AF309641:10501-10657
ggttagaggagacccctcccgaaacataacgcagcagcggggcccaacaccaggggaagctgtaccctggtggtaaggactagaggttagaggagaccccccgcataacaataaacagcatattgacgctgggagagaccagagatcctgctgtctc

SEQ ID NO: 236 - DNA, 159 bp, Dengue type 2, AF359579:10501-10659
ggttagaggagacccctcccttgcaaatcgcagcaacaatgggggcccaaggtgagatgaagctgtagtctcactggaaggactagaggttagaggagacccccccgaaataaaaaacagcatattgacgctgggaaagaccagagatcctgctgtctc

SEQ ID NO: 237 - DNA, 156 bp, Dengue type 3, AF317645:10477-10632
ggttagaggagacccctcccatgacacaacgcagcagcggggcccgagcactgagggaagctgtacctccttgcaaaggactagaggttataggagaccccccgcaaacaaaaacagcatattgacgctgggagagaccagagatcctgctgtctc

SEQ ID NO: 238 - DNA, 162 bp, Dengue type 4, AF326573:10424-10585
ggttagaggagacccctcccatcactgacaaaacgcagcaaaagggggcccgaagccaggaggaagctgtactcctggtggaaggactagaggttagaggagacccccccaacacaaaaacagcatattgacgctgggaaagaccagagatcctgctgtctc

SEQ ID NO: 239 - DNA, 633 bp, Foot and mouth disease virus, 21426907:3231-3863
accacctctgcgggtgagtctgcggaccccgtgactgccaccgtcgagaactacggtggtgagacacaagtccagaggcgccagcacacggacattgcgttcatactggacaggttcgtgaaagtcaagccaaaggaacaagttaatgtgttggacctgatgcagatccctgcccacaccttggtaggggcgctcctgcgaacggccacctactacttctctgacctggagctggccgtcaagcacgagggcgatctcacctgggtcccaaacggcgcccctgagacagcactggacaacactaccaacccaacagcttaccacaaggaacccctcacacggctggcgctgccttacacggctccacaccgtgtcttagcgaccgtctacaacgggagcagtaagtacggtgacaccagcactaacaacgtgagaggtgaccttcaagtgttagctcagaaggcagaaagaactctgcctacctccttcaacttcggtgccatcaaggcaactcgtgttactgaactactctacagaatgaagagagccgagacatactgtcccaggccccttctcgccattcaaccgagtgacgctagacacaagcagaggattgtggcacccgcaaaacag

SEQ ID NO: 240 - DNA, 846 bp, Foot and mouth disease virus, 21426907:6615-8024
gttgatcgtcgacaccagagatgtggaggagcgtgtccacgtgatgcgcaaaaccaagctcgcgcccaccgtggcgcacggtgtgttcaaccctgagttcgggcctgccgctctgtccaacaaggacccgcgcctgaacgaaggggttgtccttgacgatgtcattttctccaaacacaaaggagatacaaggatgtctgaagaggacaaagcgctgtttcggcgctgtgctgctgactacgcgtcgcgtctacacagtgtgttggggacagcaaacgccccactgagtgtgtatgaagccatcaaaggcgtcgacggacttgacgccatggagccggacacggcgcccggtctcccctgggctctccaagggaaacgccgcggcgccctgatcgacttcgaaaacggcaccgtcgggcctgaggttgaggcagcactcaagctcatggaaagccgcgagtacaaattcgtctgccaaaccttcctgaaggacgaaattcggccgctagaaaaggtacgcgctggcaagacacgcattgtcgacgtgttgcctgttgaacacattctctacaccagaatgatgattggcagattctgtgctcagatgcattcaaacaacggaccgcaaattggatcagcggtcggttgtaaccctgacgttgattggcaaagatttggcacacatttcgcccagtacaaaaacgtgtgggatgtggactactcagcctttgatgcaaaccactgcagcgatgcgatgaacatcatgttcgaggaagtgttccgcacggagttcggattccacccgaacgccgagtggattctgaagactctagtgaacacggagca

SEQ ID NO: 241 - DNA, 1035 bp, Saint Louis encephalitis virus, AF013416
aagactggagaatttgggaaggctaaaggaagcagagccatttggtacatgtggttgggagctcggttcttggagtttgaagcccttgggttcttaaatgaagaccactggatgagccgcgagaactcctatggaggagttgaggggaaaggactccagaaactcggatacatcctgcaagaaatctcccaaattccaggaggaaagatgtacgcagatgacacagccggctgggacactcggatcacaaaagaagacttgaaaaatgaagcaaaaataacaaagagaatggaagaaaggcatagaaagcttgcggaggcaatcattgatctaacctaccgccataaagtggtgaaagtcatgagaccagggcctgatggcaaaacctacatggatgtcatctccagagaagaccaaaggggcagtggacaggtggtcacatatgccctgaacaccttcaccaacctggccgttcaactgataagatgcatggaagctgaaggggtggtagatgaggatgacattacgagggtgagacttggacgattggccaaagcggttgagtggctgaggaagaatggacctgaacgattgagtagaatggcagtgagtggggacgactgtgttgtgaaaccaattgatgacagatttgccactgcactccactttctcaacaacatgtcaaagatcagaaaggacattcaggaatggaaaccttcaacaggctggcacaactggcaagaggtgcccttctgctcacaccacttcaatgaactaatgctgaaggatgggcggaccatcgtggtgccatgcaggagccaggatgagctgattggcagagccagaatttcaccaggagcaggatggaatgtgaaagagacagcctgcttgagcaaatcctatgctcagatgtggttgcttatgtacttccacaggcgggacctcagaatgatggcaaatgccatttgttcagctgtcccagtcaactgggtcccaactggacgtaccacatggtcaattcatgggaagggtgag

SEQ ID NO: 242 - DNA, 727 bp, Saint Louis encephalitis virus, AY289618
ctcggtagcaacaacacacagagagtggtttttgtgatcatgctgatgctgattgctccggcatacagcttcaactgtctgggaacatcaaacagggactttgtcgagggagccagtggggcaacatggattgacttggtacttgaagggggaagctgtgtcacagtgatggcaccagagaaaccaacactggacttcaaagtgatgaagatggaggctaccgagttagccactgtgcgtgagtattgttacgaagcaaccttggacacgctgtcaacagtggcaaggtgccccacaacaggagaagctcacaacaccaaaaggagtgacccaacatttgtctgcaaaagagatgttgtggaccgcggatggggtaacggatgtggtctgtttggaaaagggagcattgacacatgcgctaagttcacatgcaaaaacaaggcaacagggaagacgatcttgagagaaaacatcaagtatgaggttgcaatctttgtgcatggttcaacggactctacgtcacatggcaattactttgagcagattggaaaaaaccaagcggctagattcaccataagcccgcaagcaccgtcctttacggccaacatgggcgagtatggaacagttaccattgattgtgaagcaagatcaggaatcaacacggaggattattatgttttcactgtcaaggagaagtcatggctagtgaacagggactggtttcacg

SEQ ID NO: 243 - DNA, 738 bp, Rift Valley fever virus, 61928:c1652-915
atggacaactatcaagagcttcgagtccagtttgctgctcaagcagtggaccgcaatgagattgaacagtgggtccgagagtttgcttatcaagggtttgatgcccgtagagttatcgaactcttaaagcagtatggtggggctgactgggagaaggatgccaagaaaatgattgttctggctctaactcgtggcaacaagcccaggaggatgatgatgaaaatgtcgaaagaaggcaaagcaactgtggaggctctcatcaacaagtataagctaaaggaagggaatccttcccgggatgagttgactctatcacgagttgctgccgccttggctggctggacatgccaggctttggtcgtcttgagtgagtggcttcctgtcactgggactaccatggacggcctatcccctgcatacccgaggcatatgatgcaccccagctttgctggcatggtggatccttctctaccaggagactatctaagggcaatattagatgctcactctctgtatctgctgcagttctcccgggtcatcaacccaaacctccgaggtagaacaaaagaggaggttgctgcaacgttcacgcagccaatgaatgcagcagtgaatagcaactttataagccatgagaagaggagagaattcttgaaagcctttggacttgtggattccaatgggaagccgtcagctgctgtcatggcagccgctcaggcttacaagacagcagcctaa

SEQ ID NO: 244 - DNA, 798 bp, Rift Valley fever virus, 61928:35-832
atggattactttcctgtgatatctgttgatttgcagagtggtcgtcgtgttgtgtcagtggagtactttagaggagatggtcctcccaggataccttattctatggttgggccctgttgtgtctttctcatgcaccatcgtcctagtcacgaggttcgcttgcgattctctgacttctacaatgtcggagaattcccataccgagtcggacttggagactttgcatcaaacgttgcacctccaccagcgaagccttttcagagacttattgatctaataggccatatgactcttagtgatttcacaaggttccccaatctgaaagaagccatatcctggcctcttggagaaccctcactggctttcttcgacctaagctctactagagtgcataggaatgatgacattagaagggatcagattgccactctagcaatgaggagttgcaagatcaccaatgatctagaggactcctttgctggcttacacaggatgatagcgactgaggccatcctcagagggattgacctgtgcctgttgccaggctttgatctcatgtatgaggttgctcacgtacagtgcgttcggcttctgcaagcagcaaaagaggacatttctaatgctgtagttccaaactcagccctcattgttcttatggaggagagcctgatgctgcgctcatcacttcccagcatgatggggagaaacaactggattccagttattcctccaatcccagatgttgagatggaatcagaggaggagagtgatgatgatggatttgttgaggttgattag

SEQ ID NO: 245 - DNA, 1035 bp, Usutu virus, AF452643
aagctcggagagtttggtaaagcgaaaggtagtcgagccatatggttcatgtggctaggcgccagattcctggagtttgaagctctgggctttctgaatgaggaccattggttaggaagaaagaattctggaggaggtgttgaaggacttggtgtccaaaaacttggttacattctgcgtgagatgagccaccattcaggtggaaaaatgtacgcggatgacacagccggctgggacacccggataaccagagccgatcttgacaacgaggccaaagttttggagctgatggaaggtgagcacagacaactagccagagcaatcattgagctgacctacaaacacaaggtggtgaaagttatgcgacctggcacagatgggaagaccgtcatggatgtgatttcccgagaagatcagagaggaagtggacaggttgtgacctatgctctcaacacattcaccaacattgccgtccagcttattagactgatggaagctgaaggagtgattgggcaggaacatctggaaagtcttccccggaaaaccaaatacgctgtgagaacctggctctttgagaacggagaagaaagggtgacccgcatggctgtgagtggagatgattgtgttgtcaagcccctggatgatcggtttgccaatgccctgcactttctcaattcgatgtccaaggtcagaaaagacgtgccagagtggaaaccctcctcgggatggcacgattggcagcaagtgcctttctgctcaaaccactttcaggaattgatcatgaaggacggaaggactttggtggttccctgccggggtcaggatgaactcattgggagggcgcgagtctcccccggctctggatggaatgttagggacaccgcatgcttggccaaggcctacgctcagatgtggctcctgctgtacttccacagaagagatctgaggctgatggcaaacgccatctgttcagcagtccccagcaattgggttcccactggcaggacttcatggtcagtgcatgccacaggtgag

SEQ ID NO: 246 - DNA, 1035 bp, Japanese encephalitis virus, M18370:9062-10097
aagcctggagagtttggaaaagctaaaggaagcagggccatttggttcatgtggcttggagcacggtatctagagtttgaagctttggggttcctgaatgaagaccattggctgagccgagagaattcaggaggtggagtggaaggctcaggcgtccaaaagctgggatacatcctccgtgacatagcaggaaagcaaggagggaaaatgtacgctgatgacaccgccggatgggacactagaattaccagaactgatttagaaaatgaagccaaggtgctggagctcctagacggtgaacaccgcatgctcgctcgagccataattgaactgacttacaggcacaaagtggtcaaggtcatgagacctgcagcagaaggaaagaccgtaatggacgtgatatcaagagaagatcaaagggggagtggacaggtggtcacttatgcccttaacactttcacgaacattgctgtccagctcgtcaggctgatggaggctgagggggtcattggaccacaacacttggaacagctacctagaaaaaccaagatagctgtcaggacctggctctttgagaatggagaggagagagtgaccaggatggcgatcagcggagatgactgtgtcgtcaagccgctggatgacagattcgccacagccctccacttcctcaacgcaatgtcaaaggtcagaaaagacatccaggaatggaagccttcgcatggctggcacgactggcagcaagttcccttctgctctaaccattttcaggagattgtgatgaaagatggaaggagcatagttgtcccgtgcagaggacaggatgagctgataggcagggctcgcatctctccaggagctggatggaatgtgaaggacacagcttgtctggccaaagcatatgcacagatgtggctactcctatacttccatcgtagggacttgcgtctcatggcaaatgcgatttgctcagcagtgccagtggattgggtgcccacaggcaggacgtcctggtcaatacactcgaaaggagag

SEQ ID NO: 247 - DNA, 755 bp, Chandipura virus, 4583436:97-851
aacagaaatcccagattctctgttgcttaccactatcgcatcaagatgcaacgtctgaagaagtttatagccaagagagaaaagggtgataaaggaaagatgaaatggaacagctcgatggattatgactccccccctagttaccaggatgtaagaaggggtatttttcctacagcgcccttatttggcatggaagatgatatgatggaatttactccatctctggggatccagacattaaagcttcagtataaatgtgtagtaaacatcaatgcgatcaatccattcagagatttccgtgaggcaatatcagccatgcagttctgggaagctgactacagtggatacattgggaagaaaccattttacagagcaataattctccatactgctcggcaattaaaaacatccaatccaggtattctcgatcgcggagtggtagaatatcatgccaccactcaaggacgggcattagtctttcacagccttggaccttctccttccatgatgtttgtcccagaaacttttacccgagaatggaatattcttacaaacaaggggacaatcaatgtaaagatttggcttggggaaactgatactctatcagagttggagccaatcctcaacccggtcaatttccgagacgaccgagaaatgattgaaggggcagcaataatgggcttggaaataaaaaagcagaaggacaacacatggctgatttctaagagtcattgaaatgtaccatatgaaaaaaa

SEQ ID NO: 248 - DNA, 752 bp, Chandipura virus, J04350
atcactctcacatggaaggtgctcgaacttgcagattgagttattgcggtcggaacggaatcaaattccccaatggagagtgggtcagcctgatgttaaaactaagatccaagagaaacctttacttcccttgtttaaagatgtgtccgaccgggatcagaggtgagatctacccttcaatccgatgggctcaagtcttgacctcagagattcagaggattttggattattccttgtgtcagaacacgtgggacaaggtagaacgcaaagagccgttgtctccattggatctaagctatttggcatctaaatctccggggaaaggtctggcatatacagtgataaatgggacattgtcatttgcccatactagatacgtgaggatgtggattgatggcccggtgttgaaagaacctaaaggcaaaagggaatcccctagtgggatctcgagtgatatttggacccaatggttcaaatatggggatatggagataggtccaaacggcctattaaagacagcaggagggtacaaattcccctggcatctgatcggtatgggaattgttgacaatgaactacacgagctcagtgaggcaaaccctttagaccatccacagctacctcatgctcagtcaattgccgacgattcagaggagatcttctttggagacactggggtttccaagaatccagtagaactggttacagggtggttcactagctggaaagagagtttagctgccggtagttgt

SEQ ID NO: 249 - DNA, 523 bp, Arabidopsis thaliana(2); identical to SEQ ID NO: 56

SEQ ID NO: 250 - DNA, 523 bp, Arabidopsis thaliana(3); identical to SEQ ID NO: 56

SEQ ID NO: 251 - DNA, 398 bp, Streptococcus pyogenes
gcttcagtagcggtagctttgactgttttaggggcaggttttgcgaatcaaacagaggttaaggctaacggtgatggtaatcctagggaagttatagaagatcttgcagcaaacaatcccgcaatacaaaatatacgtttacgtcacgaaaacaaggacttaaaagcgagattagagaatgcaatggaagttgcaggaagagattttaagagagctgaagaacttgaaaaagcaaaacaagccttagaagaccagcgtaaagatttagaaactaaattaaaagaactacaacaagactatgacttagcaaaggaatcaacaagttgggatagacaaagacttgaaaaagagttagaagagaaaaaggaagctcttgaattagcgatagaccaggcaag

SEQ ID NO: 252 - DNA, 360 bp, Streptococcus pyogenes
gcatccgtagcagtcgctgtggctgttttaggagcaggctttgcaaaccaaacaacagttaaggcgaacagtaagaaccctgtccctgtcaaaaaagaagcaaaattaagtgaagcagaattacatgacaaaattaaaaaccttgaagaggaaaaagcagaattattcgagaaattagataaagttgaagaagagcataaaaaagttgaagaagagcataaaaaagatcatgaaaaacttgaaaaaaaatcagaagatgtagaacgtcactacctcagacaactagatcaagagtataaagaacaacaagaacgtcaaaaaaatctagaggaactcgaacgccaaagtcaacgagaagtc

SEQ ID NO: 253 - DNA, 391 bp, Streptococcus pyogenes
acggcttcagtagcggttgctttgacagttttagggacaggactggtagcagggcagacagtaaaggcagatgctaggagtgttaatggagagtttcctagacatgttaaattaaaaaatgaaattgagaacttgttagatcaggttacacaattatataataaacataatagtaattaccaacaatatagtgcacaagctggcagacttgacctgagacaaaaggctgaatatctaaaaggccttaatgattgggctgagaggctgttacaagagttaaatggagaagatgtaaaaaaagttttaggtaaagtggcttttgaaaaagatgatttagaaaaggaggttaaagaacttaaggaaaaaatagacaaaaaggaaaaggaatatc

SEQ ID NO: 254 - DNA, 337 bp, Streptococcus pyogenes
agcatcagtagcggtcgctgtggctgttttaggagcaggctttgcaaaccaaacagaagttaaggctgcggagattaaaaagcctcaggctgattcagcgtggaactggcctaaagaatataacgcgttacttaaggaaaatgaggagctcaaggtagaacgtgaaaaatatctatcttatgctgacgataaagaaaaagatcctcaatatagagcattaatgggtgaaaatcaagatcttcgaaaaagagagggacaatatcaggacaaaatagaagaacttgaaaaagaaagaaaagaaaaacaagaaagacaagaacaattagaacgtcaatat

SEQ ID NO: 255 - DNA, 490 bp, Streptococcus pyogenes
actgcatcagtagcagtagctttgagtgtcttaggagcaggattagttgtcaatactaatgaagttagtgcagccgtgactaggggtacaataaatgacccgcaaagagcaaaagaagctcttgacaagtatgagctagaaaaccatgacttaaaaactaagaatgaagggttaaaaactgagaatgaagggttaaaaactgagaatgaagggttaaaaactgagaatgaagggttaaaaactgagaagaaagaacatgaagcagaaaacgataagttaaaacaacagagggatacgttatctactcagaaagaaactcttgaaagagaagtacagaacacgcaatacaataatgaaacgttaaagattaagaatggtgacttaactaaagagttgaataaaactcgacaagaattagcaaataaacagcaagagagtaaagaaaatgaaaaggcccttaatgaactcttggaaaagacagtaaaagata

SEQ ID NO: 256 - DNA, 437 bp, Streptococcus pyogenes
tactgcatcagtagcagtggctttgagtgtaataggggcaggattagttgtcaatactaatgaagttagtgcaagagtgtttcctagggggacggtagaaaacccggacaaagcacgagaacttcttaacaagtatgacgtagagaactctatgttacaagctaataatgacaagttaacaactgagaataaaaacttaacagatcagaataaaaacttaacagatcagaataaggagttaaaagctgaggagaataggctaacaactgagaataaagggttaactaaaaagttgagtgaagctgaagaagaagcagcaaataaagagcaagaaagtaaagaaaccattggtacccttaaaaaaaccttggatgagacagtaaaagataaaattgctaaggagcaagaaagtaaagaaaccattggtaccttaaaaa

SEQ ID NO: 257 - DNA, 509 bp, Streptococcus pyogenes
caggtacagcatccgtagcggtcgctgtggctgttttaggagcaggctttgcaaaccaaacagaagttaaggcggaaggggttaagaaggcggaagaagcaaaactatctgttcccaaaactgaatacgataaattatatgatgattatgataaactgcaagaaaaaagtgctgagtacctagaaagaataggagaactggaagagcgacaaaaaaatctagaaaagctagaacgtcaatctcaagtagcagcagataaacattatcaagagcaggtaaaaaaacatcaagagtataaacaagaacaagaagaacgtcaaaaaaatctagaagaactcgaacgtcaaaataaacgagaaatagacaaacgttataaagaacaactccacaaacaacaacaattagaaacagaaaagcaaatctcagaagctagtcgtaagagcctaagccgtgaccttgaagcgtctcgcgaagctaagaaaaaagtagaagcagatctagctgctctt

SEQ ID NO: 258 - DNA, 500 bp, Streptococcus pyogenes
gcatccgtagcggtcgctgtggctgttttaggagcaggctttgcaaaccaaacagaagttaaggcaactgaagttaaggctgcggggcaaagcgctcctaaaggtacaaacgtgagcgcagacctatataattcgctatgggatgaaaataaaactcttagagaaaaacaagaagagtatataacaaaaattcaaaatgaagagacaaaaaataaagagttagataagaaaaataaagaattagactctcgagttacagatctcatagacgtaattgaacatgacgatcaagaacttaaacgcaaagatcgcatgtacgaagctttcttaaaacagtctaaagatcaggttaaagacctgaatgctgaaaaagatacactggcagaaaaagccaaaaaacttgaagaagacaaacaaatctcagacgcaagccgtcaaggtctaagccgtgaccttgaagcgtctcgtgcagctaaaaaagagcttgaagcaaatcacca

SEQ ID NO: 259 - DNA, 364 bp, Streptococcus pyogenes
gcttcagtagcggttgctttaacagtcgtaggagcagggttagtagcagggcagacagtaagagcagatcatagtgatttagtcgcagaaaaacaacgtttagaagatttaggacaaaaatttgaaagactgaaacagcgttcagaactctaccttcagcaatactatgataataaatcaaatggatataaaggtgactggtatgtacaacagttaaaaatgttaaatcgtgacttggaacaagcgtataatgagcttagcggagaagcacataaagatgccttagggaaactgggaattgataacgctgacctaaaagctaaaattactgaactggaaaaatctgttgaagagaaaaatgatg

SEQ ID NO: 260 - DNA, 325 bp, Streptococcus pyogenes
cagcatccgtagcggtcgctgtggctgttttaggagcaggctttgcaaaccaaacaacagttaaggctgcggacccccagaaacagaacagcgtttctaatgatagcgtgagcataaatgtatataataagctatcgggtgactatgataagctattggataaacatggtgagctattgagtgaatatgatgctcttaaagaaaaactagataaagatcaagaagaacgcgaaaaattagagcttgactatctcaaaaaactagatcacgagcacacagagcaccaaaaagaacaacaagaacaagaagagcgacaaaaaaatca

SEQ ID NO: 261 - DNA, 524 bp, Streptococcus pyogenes
actgcttcagtagcggttgctttgagtgccttaggggtaggattagcggttaaccaaacagaagttagcgcagcacctcttactcgagctacagcagacaataaagacgaattaataaaaagagctaacgattatgagatacagaaccatcagttaacagttgagaataaaaaattaaaaactgataaggaacagttaacaaaagagaatgatgatttaaaaactgagaaggatcagttagaacaacggagtgagaagttagctactcagaaagaaaatcttgaaaaagaagtagcggaagcgaaacacaagaatgaaacgttaaacattaataatgatgacttaactaaaaagttgaatgaaactcgacaagaattagcaaataaacagcaagagagtaaagaaaatgaaaagacccttaatgaactcttggaaaagacagtaaaagataaaattgcgagagagcaaaaaagtaaacaagactttggtgcccttaaacaagaattggctaaaaaagaagaaca

SEQ ID NO: 262 - DNA, 620 bp, Streptococcus pyogenes
gcatcagtagcggtcgctgtggctgttttaggagcaggctttgcaaaccaaacaacagttaaggcggagtcatcaaataatgcggagtcatcaaacatttctcaagaaagcaaactaataaatacattgactgatgaaaatgagaaactcagagaagagctccaacagtattatgcattaagtgatgctaaagaagaagaacctaggtataaagcattgagaggcgaaaatcaagatcttcgggaaaaagaaagaaaataccaggataaaataaaaaaattagaagaaaaagagaaaaacctagaaaaaaaatcagaagatgtagaacgtcactatcttaaaaaactagatcaagaacataaagaacaacaagaacgtcaaaaaaatctagaggaactcgaacgtcaaagtcaacgagaaatagacaagcgttatcaagaacaactccaaaaacaacaacaattagaaacagaaaagcaaatctcagaagctagtcgtaagagcctaagtcgtgaccttgaagcgtctcgtgcagctaagaaaaaagtagaagcagacctagctgctcttaatgctgagcaccaaaaactcaaagaggaaaaacaaatctcagacgcaag

SEQ ID NO: 263 - DNA, 333 bp, Streptococcus pyogenes
cagcatccgtagcggtcgctgtggctgttttaggagcaggctttgcaaaccaaacagaagttaaggctgcggagtctccaaaaagtactgagacttctgctaatggagctgataaattagctgatgcatacaacacattgcttactgaacatgagaaactcagagatgagtattatacattaattgatgctaaagaagaagaacctaggtataaagcattgagaggcgaaaatcaagatcttcgggaaaaagaaggaaaataccaggataaaataaaaaaattagaagaaaaagagaaaaatttagaaaaaaaatcagaagatgtagaacgtc

SEQ ID NO: 264 - DNA, 328 bp, Streptococcus pyogenes
tgcatcagtagcagtggctttgagtgtaataggggcaggattagttgtcaatactaatgaagttagtgcaagagtgtatattactaggggtatgacaaaagaggacgtagaaaaaattgctaacgaccttgacacagaaaaccatgggttaaaacaacagaatgaacagttatctactgataaacaaggtcttgaagaacagaataaacagttatctactgagaaacaaggtcttgaagaacagaataaacagttatctactgagaaacaaggtcttgaagaacaaaataaacagttatctactgagaaacaaggtcttgaagaacag

SEQ ID NO: 265 - DNA, 391 bp, Streptococcus pyogenes
cagcatcagtagcggtcgctgtggctgttttaggagcaggctttgcaaaccaaacagaagttaaggctgcggagtcgcgaagcgtttctcaaggtagcgtgagcctagagctatatgataagctatcggatgaaaatgatattcttagagaaaaacaagacgagtatctaacaaaaattgacgggttagataaagaaaataaagagtatgcaagtcaacttgctaaaaatcaaaaggaacgcgaagaattagagctcgaatacctcagaaaatcagataaagagtataaagagcatcaacaatatcgacaagaacaagaagaacgtcaaaaaaatcaagaacaattagaacgtaaatatcaacgagaagtagaaaaacgctatcaagaaca

SEQ ID NO: 266 - DNA, 325 bp, Streptococcus pyogenes
gcatcagtagcggtcgctgtggctgttttaggagcaggctttgcaaaccaaacagaagttaaggctgcggagtcgcgaagcgtttctcaaggtagcgtgagcctagagctatatgataagctatcggatgaaaatgatattcttagagaaaaacaagacgagtatctaacaaaaattgacgggttagataaagaaaataaagagtatgcaagtcaacttgctaaaaatcaaaaggaacgcgaagaattagagctcgaatacctcagaaaatcagataaagagtataaagagcatcaacaatatcgacaagaacaagaagaacgtc

SEQ ID NO: 267 - DNA, 451 bp, Streptococcus pyogenes
tccgtagcggtcgctgtggctgttttaggagcaggctttgcaaaccaaacagaagttaaggcggaagaagaacgtacttttactgagttaccatatgaagcacgatacaaagcatggaaaagtgaaaatgatgagcttcgggaaaattatagaaggaccttagataagtttaatactgagcaaggtaagactacgagattagaagaacaaaataaaaagctacattctgaacttgcatctgtaacagaaactcttacatctgtaacagaagctgatgataaaaaaattaaagatttaactgacagggataagattagcagtaacctattaggcaacgctaaagatcaaattaataagctcacgactgaaaaagatacactggcagaaaaagccaaaaaacttgaagaagataaacaaatttcagatgcaagccgcaagagcctaagccgtg

SEQ ID NO: 268 - DNA, 450 bp, Streptococcus pyogenes
gctcagtagcagttgctttgactgttttaggagcaggctttgcaaaccaaacagaagttaaggcggaaggggtttctgtaggttcagatgcatcactacataaccgcattacagaccttgaagaggaaagagaaaaattattaaataaattagataaagttgaagaagagcataaaaaagatcatgaacaacttgaaaaaaaatcagaagatgtagaacgtcactacctcagacaactagatcaagaacataaagaacaacaagaacgtcaaaaaaatctagaggaactcgaacgtcaaagtaaacgagaaatagacaaacgctatcaagaacaactccaaaaacaacaacaattagaaacagaaaagcaaatctcagaagctagtcgtaagagcctaagccgcgaccttgaagcttctcgtgcagctaaaaaagagcttgaagctgagc

SEQ ID NO: 269 - DNA, 378 bp, Streptococcus pyogenes
catcagtagcggtcgctgtggctgttttaggagcaggctttgcaaaccaaacaacagttaaggcggacagtgacaatattaatagatctgtctctgtcaaagataatgaaaaagaattacataacaaaattgcagaccttgaagaggaaagaggagaacatctagacaaaatagatgaactaaaagaagaactaaaagcaaaggagaaaagttcagaaaacgtagaacgtcactacctcagaaaactagatcaagaatataaagaacaacaagaacgtcaaaaaaatctagaggaactcgaacgccaaagtcaacgagaagtagaaaaacgttatcaagaacaactccaaaaacaacaacaattagaaacagaaaagc

SEQ ID NO: 270 - DNA, 516 bp, Streptococcus pyogenes
gcatcagtagcggtcgctgtggctgttttaggagcaggctttgcaaaccaaacagaagttaaggcggaagaagcatcaaataatgggcaactcacattacagcataaaaataatgcattgactagtgagaatgagtctcttagaagagaaaaagatagatatttgtatgaaaaagaagaattagaaaagaaaaataaagagttagattctcaggtcgctggcctaataggtgtagttgagagtgatgaagaagaagctaagcgctcaaagaacatgtacgaaactttcttaaaacagtctaaagatcaggttaatgagctgactgctgaaaaagatacactggcagaaaaagccaaaaaacttgaagaagacaaacaaatctcagacgcaagccgcaagagcctaagccgtgaccttgaagcatctcgtgcagccaaaaaagagcttgaagctaaacaccaaaagctagagactgaacaccaaaaactcaaagaagacaaacaaatctcagacgca

SEQ ID NO: 271 - DNA, 952 bp, Streptococcus pyogenes, AF095713
tggtcctatcggtcgtgtgtatcacgaccatatcgaagatcagtatcgtgggttttccatgacacaaaaggtatattctaatcggactggaaaatttgtgggctatgttcaagtctttcatgatttaggcaattattatgtcattagagcaagactgctgttttggctactagttgttgagttatttggcacaagcttagcctatttaatcatcttaattactacgcggcgctttttgaagcctttacacaatttacatgaagtgatgcgtaatatctctgaaaatcctaataatttaaacctgcgctcagatatttcgtcaggagatgaaatcgaagaattgtctgttatctttgacaatatgttagacaaattggagacacatactaagttgcaatcacgttttattagtgatgtcagccatgaattacgaacaccggttgcgattattaaagggcatattggtctcttacaacgttggggtaaagatgacagtgatattcttgaagaaagcttgacagcaacagcgcatgaggctgaccgtatggcaatcatgattaatgatatgttagacatggttcgcgtacaaggctcatttgagggacatcaaaatgatatgacagttttggaagattctattgaaactgttgttggtaattttagagttttaagagaagattttatctttacatggcagtcagaaaatccaaaaacgatagcccgtatttataaaaatcattttgagcaggctttgatgattctgattgacaatgctgtgaagtattcccgtaaagaaaagaaaatcgcgattaacctttcagtgactggcaaacaagaagctattgttagagttcaagataaaggcgaaggaatttctaaagaagatattgaacatatctttgaacgcttttatagaacggataaatcacgtaatcgaacaagtacccaggct

SEQ ID NO: 272 - DNA, 615 bp, Streptococcus pyogenes, AJ347842
agaacctgcgcttcccccattaatgccagagctagatggtgaagaagtcccagaagttccaagcgagagcttagaacctgcgcttcccccattgatgccagagctagatggtgaagaagtcccagaagttccaagcgagagcttagaacctgcgcttcccccattgatgccagagctagatggtgaagaagtcccagaagttccaagcgagagcttagaacctgcgcttcccccattaatgccagagctagatggtgaagaagtcccagaagttccaagcgagagcttagaacctgcgcttcccccattgatgccagagttagatggtgaagaagtccctgaaaaacctagtgttgacttacctattgaagttcctcgttatgagtttaacaataaagaccagtcacctctagcgggtgagtctggtgagacggagtatattaccgaagtctatggaaatcaacagaaccctgttgatattgataaaaaacttccgaatgaaacaggtttttcaggaaatatggttgagacagaagatacgaaagagccagaagtgttgatgggaggtcaaagtgagtctgttgaatttactaaagacactcaaacaggcatgag

SEQ ID NO: 273 - DNA, 729 bp, Streptococcus pyogenes, AB051298
actctaccagcggatcatttgacgttaacggtaaagaaaacattgcttccttcatggaaagttatgtcgaacaaatcaaagaaaacaaaaaattagacactacttatgctggtaccgctgagattaaacaaccagttgttaaatctctccttgattcaaaaggcattcattacaatcaaggtaacccttacaacctattgacacctgttattgaaaaagtaaaaccaggtgaacaatcttttgtaggtcaacatgcagctacaggatgtgttgctactgcaactgctcaaattatgaaatatcataattaccctaacaaagggttgaaagactacacttacacactaagctcaaataacccatatttcaaccatcctaagaacttgtttgcagctatctctactagacaatacaactggaacaacatcctacctacttatagcggaagagaatctaacgttcaaaaaatggcgatttcagaattgatggctgatgttggtatttcagtagacatggattatggtccatctagtggttctgcaggtagctctcgtgttcaaagagccttgaaagaaaactttggctacaaccaatctgttcaccaaatcaaccgtagtgactttagcaaacaagattgggaatcacaaattgacaaagaattatctcaaaaccaaccagtatactaccaaggtgtcggtaaagtaggcggacatgcctttgttatcgatg

SEQ ID NO: 274 - DNA, 815 bp, Streptococcus pneumoniae, AY157689
gaggatttgattgaagaatcggatgttttaattacgctttctaataagggatacatcaaacgtttggaccaagctgaatttactgctcaaaaacgtgggggccgcggcgttcaagggacaggcgttaaggatgacgattttgttcgtgagttagtgtcaactagcacccatgatcacctgctcttctttacaaataaaggacgtgtctatcgtctgaaaggttatgaaattcctgagtatggtcggacggccaaaggtctaccagttgtcaatctcttgaaattggatgaaggtgaaagtattcagacgattatcaatgttgagtctgaacgcagtgatgatgcttacctcttctttacaacccgtcatggtattgtgaagagaaccagcgtcaaggaatttgctaacattcgtcaaaatggtctcaaagcactgaatctaaaggatgaagatgagttgattaatgtcttgttgacggaagaagatacggatattattattggtaccaagtttggttatgcagttcgctttaatcaatcagccgttcgcggcatgagtcgtatcgccacaggtgtgaaaggtgtgaacctccgtgagggagacacagtggttggtgctagtgtgattacagatcaagacgaggttcttatcatcacagaaaaaggatatggtaagcgtacagtcgcgactgaatatccaacaaaaggtcgtggtggtaaagggatgaagacggctaatgtggctgaaaaaaatggtcctctatcaggtctcttgactgtgaaaggtgatgaagacttgatgattatcactgatac

SEQ ID NO: 275 - DNA, 125 bp, Streptococcus pneumoniae; identical to SEQ ID NO: 31

SEQ ID NO: 276 - DNA, 99 bp, Streptococcus pneumoniae; identical to SEQ ID NO: 32

SEQ ID NO: 277 - DNA, 821 bp, Staphylococcus aureus, D10489
gaagacttaattccagaagaacaaatagtaattacactaagccataataactacattaaacgtttgccggtatctacatatcgtgctcaaaaccgtggtggtcgtggtgttcaaggtatgaatacattggaagaagattttgtcagtcaattggtaactttaagtacacatgaccatgtattgttctttactaacaaaggtcgtgtatacaaacttaaaggttacgaagtgcctgagttatcaagacagtctaaaggtattcctgtagtgaatgctattgaacttgaaaatgatgaagtcattagtacaatgattgctgttaaagaccttgaaagtgaagacaacttcttagtgtttgcaactaaacgtggtgtcgttaaacgttcagcattaagtaacttctcaagaataaatagaaatggtaagattgcgatttcgttcagagaagatgatgagttaattgcagttcgcttaacaagtggtcaagaagatatcttgattggtacatcacatgcatcattaattcgattccctgaatcaacattacgtcctttaggccgtacagcaacgggtgtgaaaggtattacacttcgtgaaggtgacgaagttgtagggcttgatgtagctcatgcaaacagtgttgatgaagtattagtagttactgaaaatggttatggtaaacgtacgccagttaatgactatcgcttatcaaatcgtggtggtaaaggtattaaaacagctacgattactgagcgtaatggtaatgttgtatgtatcactacagtaactggtgaagaagatttaatgattgttactaatgc

SEQ ID NO: 278 - DNA, 705 bp, Staphylococcus aureus, 18266750:2118-2822
atgaataaaaaattactaatgaatttttttatcgtaagccctttgttgcttgcgacaatcgctacagattttacccctgttcccttatcatctaatcaaataatcaaaactgcaaaagcatctacaaacgataatataaaggatttgctagactggtatagtagtgggtctgacacttttacaaatagtgaagttttagataattccttaggatctatgcgtataaaaaacacagatggcagcatcagccttataatttttccgagtccttattatagccctgcttttacaaaaggggaaaaagttgacttaaacacaaaaagaactaaaaaaagccaacatactagcgaaggaacttatatccatttccaaataagtggcgttacaaatactgaaaaattacctactccaatagaactacctttaaaagttaaggttcatggtaaagatagccccttaaagtattggccaaagttcgataaaaaacaattagctatatcaactttagactttgaaattcgtcatcagctaactcaaatacatggattatatcgttcaagcgataaaacgggtggttattggaaaataacaatgaatgacggatccacatatcaaagtgatttatctaaaaagtttgaatacaatactgaaaaaccacctataaatattgatgaaataaaaactatagaagcagaaattaattaa

SEQ ID NO: 279 - DNA, 729 bp, Staphylococcus aureus, 18266750:13059-13787
atgaaaaaattaataagcatcttattaataaatataataattttaggtgtctctaataatgccagcgctcaaggcgatataggaattgataatctcaggaatttttatacaaaaaaagactttgtagatttaaaagatgtaaaagacaatgatactcctatagctaatcaactacaattttcaaatgaatcttatgatttaatttcagaatcaaaagattttaataaatttagtaatttcaagggaaaaaaacttgatgtttttggtattagttataatggccagtgtaacactaaatacatatatggtggagtcacagctactaacgaatatctagataaatctagaaatatacctataaatatatggatcaatggaaatcacaaaactatttctaccaataaagtttcgacaaataaaaaattagttaccgctcaagagattgatgtcaaattaagaaagtaccttcaagaagaatacaacatttatggacataacggcactaaaaaaggagaagaatatggtcataaatcaaaattttattctggatttaatattggtaaagtaacgttccatttaaataataatgacactttttcatatgatttattctacacaggagatgatgggttaccaaaaagttttttaaaaatttacgaagacaataaaactgtagagtctgagaaattccatttggatgtcgatatttcttataaagaaacgatataa

SEQ ID NO: 280 - DNA, 771 bp, Staphylococcus aureus, 18266750:12265-13035
atgcctatatggcgttgtaatataaaaaaaggagccatcaaaatgaataaaatatttagaatactcactgttagcttgtttttcttcacatttttaataaaaaacaatctagcatatgctgatgtaggggtaatcaaccttagaaacttttatgctaattatgaacctgaaaagcttcaaggagttagttctggaaatttttctacttctcatcaattagagtatattgatggaaaatacactttatattcacagtttcataatgaatatgaagcgaagagattaaaagatcataaagtagatatctttggaataagttactcaggtctttgtaatacaaaatatatgtatggtggaattacgttggcgaatcaaaatttagataaacctagaaatatacctattaatctctgggtcaatggtaagcaaaatactatatctacagacaaagtttctactcaaaaaaaagaggtaactgctcaagagattgatattaagttacgaaaatacctacaaaacgaatacaatatatatggttttaataaaacaaaaaaaggtcaggaatatggatatcagtcaaaatttaattctgggtttaacaaaggaaaaattactttccatttaaataatgaaccttcttttacatacgatttgttttacaccggaactggtcaagcagagagttttttaaaaatttacaatgataataaaactatagatgcagagaattttcatttggatgtagagatttcatatgagaaaactgaataa

SEQ ID NO: 281 - DNA, 824 bp, Chlamydia pneumoniae, 28415636:2451-4955
gaagacatcattaccaatgagtctgttattatcacgatatccggagatgattacgtaaagagaatgcctgtaaaagtgttcaaagaacaacgtcgtggcgggcatggagttacgggatttgatatgaagaagggagcagggttccttaaagctgtatactctgcctttactaaagactatctcttaatcttcaccaattttggccaatgttattggttgaaggtatggcagctcccagaaggggagcggagggcgaaaggtaagcccatcatcaacttcctagagggaattcgtcctggtgaggagctcgcagctatattgaatattaagaattttgataatgccggcttcttatttttagccaccaaacgtggtgttgtgaaaaaagtttccttagacgcctttagcaaccctaggaaaaagggaatacgtgctttagagatagatgagggagacgaactcatagcagcttgtcacattgttagtgatgaagagaaggtaatgttatttactcatcttggtatggcagttcgcttcccccatgaaaaagttcgtcctatgggtagaactgcacgtggggttcgcggtgtctctttgaaaaatgaagaagataaagttgtcagttgtcaaattgtgactgagaaccagtcggttttaattgtatgtgatcaaggttttggtaagagatctttagttgaagatttccgcgaaaccaatcgtggaggcgtgggcgtacgttctatccttatcaatgaaagaaacggcaatgtcctaggagctattcctgttacggatcacgacagtattttattaatgtcgagtca

SEQ ID NO: 282 - DNA, 1030 bp, Chlamydia pneumoniae, X53511
gcgaagctgaattcgtaagcagtgatccagaaacaactcctacaagtgatgggaaattagtctggaaaatcgatcgcctgggtgcaggagataaatgcaaaattactgtatgggtaaaacctcttaaagaaggttgctgcttcacagctgctactgtatgtgcttgcccagagctccgttcttatactaaatgcggtcaaccagccatttgtattaagcaagaaggacctgactgtgcttgcctaagatgccctgtatgctacaaaatcgaagtagtgaacacaggatctgctattgcccgtaacgtaactgtagataatcctgttcccgatggctattctcatgcatctggtcaaagagttctctcttttaacttaggagacatgagacctggcgataaaaaggtatttacagttgagttctgccctcaaagaagaggtcaaatcactaacgttgctactgtaacttactgcggtggacacaaatgttctgcaaatgtaactacagttgttaatgagccttgtgtacaagtaaatatctctggtgctgattggtcttacgtatgtaaacctgtggagtactctatctcagtatcgaatcctggagacttggttcttcatgatgtcgtgatccaagatacactcccttctggtgttacagtactcgaagctcctggtggagagatctgctgtaataaagttgtttggcgtattaaagaaatgtgcccaggagaaaccctccagtttaaacttgtagtgaaagctcaagttcctggaagattcacaaatcaagttgcagtaactagtgagtctaactgcggaacatgtacatcttgcgcagaaacaacaacacattggaaaggtcttgcagctacccatatgtgcgtattagacacaaatgatcctatctgtgtaggagaaaatactgtctatcgtatctgtgtaactaaccgtggttctgctgaagatactaacgtatctttaatcttgaagttctcaaaagaacttcagccaatagcttcttcaggtcc

SEQ ID NO: 283 - DNA, 150 bp, Chlamydia pneumoniae; identical to SEQ ID NO: 42

SEQ ID NO: 284 - DNA, 133 bp, Chlamydia pneumoniae; identical to SEQ ID NO: 43

SEQ ID NO: 285 - DNA, 346 bp, Chlamydia pneumoniae; identical to SEQ ID NO: 44

SEQ ID NO: 286 - DNA, 991 bp, Chlamydia psittaci, AF269281
ggaacccagctgaaccaagtttattaatcgatggcactatgtgggaaggtgcttcaggagatccttgcgatccttgcgctacttggtgtgacgccattagcatccgcgcaggatactacggagattatgttttcgatcgtgtattaaaagttgatgtgaataaaacttttagcggcatggctgcaactcctacgcaggctacaggtaacgcaagtaatactaatcagccagaagcaaatggcagaccgaacatcgcctacggaaggcatatggaagatgcagagtggttttcaaatgcagccttcctagccttaaacatttgggatcgcttcgacattttctgcaccttaggggcatccaatggatacttcaaagcaagttcggctgcattcaacttggttgggttaatagggttttcagctgcaagctcaatctctaccgatcttccaacgcaacttcctaacgtaggcattacccaaggtgttgtggaattttatacagacacatcattttcttggagcgtaggtgcacgtggagctttatgggaatgtggttgtgcaactttaggagctgagttccaatacgctcaatctaatcctaagattgaaatgctcaacgtcacttcaagcccagcacaatttgtgattcacaaaccaagaggctataaaggagctagctcgaattttcctttacctataacggctggaacaacagaagctacagacaccaaatcagctacaattaaataccatgaatggcaagtaggcctcgccctgtcttacagattgaatatgcttgttccatatattggcgtaaactggtcaagagcaacttttgatgctgatactatccgcattgctcaacctaaattaaaatcggagattcttaacattactacatggaacccaagccttataggatcaaccactgctttgcccaataatagtggtaaggatgttctatctgatgtcttgcaaattgcttcgattca

SEQ ID NO: 287 - DNA, 883 bp, Chlamydia psittaci, U04442
cgcaagcttatctgcgttgtttccattgtcgtcacaatgttaccgaagatttcggtgaggttgtctttaaagcatatgattctttcttacaattggaacagcaaatcaatgatttgaaggttcgagcagaaagaaataagtttgcagcagcaaaattagacgctgctaagcgtagattatacaagcgagaagttgcagcaggaagaactctggaagagttcaaaaaagacgtgcgtatgctgcagcgttggatggacaagagccaggaagctaaaaaagaaatggttgagtccaaccttcgtttagtgatttccatagctaaaaaatatacaaaccgcggcctttccttcttagatttgattcaagaggggaatatgggcttgatgaaagctgtagaaaaatttgaatatcgcagaggatataaattttctacttatgccacatggtggattcgtcaagctgttacacgtgctattgcagatcaggcacgaaccatccgtattcctgtgcacatgattgaaactataaacaaagttcttcgtggtgctaagaaattaatgatggaaacgggcaaagagcctacaccagaggaattggccgaagagttaggattaacccctgatcgggtgcgggaaatttataaaattgctcagcatccaatttctttacaagcagaggttggtgagggaggcgaaagctcctttggcgactttttggaagatactggtgtggagtctccagcagaggccacaggctattctatgcttaaagataaaatgaaagaggtgttaaaaacccttacggatcgtgaacgttttgttttgattcatcgttttggtcttttggatggcaagcctaaaacactagaagaggtgggttcagc

SEQ ID NO: 288 - DNA, 913 bp, Corynebacterium diphtheriae, A04646
gacgtggtcaaagtgacgtatccaggactgacgaaggtcctcgcactaaaagtggataatgccgaaactattaagaaagagttaggtttaagtctcactgaaccgttaatggagcaagtcggaacagaagagtttataaaaaggttcggggatggtgcttcgcgtgtagtactcagccttccctttgccgaggggagttctagcgtcgaatatattaataactgggaacaggcgaaagcgttaagcgtaaaacttgagattaattttgaaacccgtggaaaacgtggccaagatgcgatgtatgagtatatggctcaagcctgtgcaggaaatcgtgtcaggcgatcagtaggtcgctcattgtcatgcataaatcttgattgggatgtcataagggataaaactaagacaaagatagagtctttgaaagagcatggccctatcaaaaataaaatgagcgaaagtcccaataaaacagtatctcaggaaaaagctaaacaatacctagaagaatttcatcaaaccgcattagagcatcctcaattgtcagaacttaaaaccgttactgggaccaatcctctattcgctggggctaactatgcggcgtgggcagtaaacgttgcgcaagttatcgatagcgaaacagctgataatttggaaaagacaactgctgctctttcgatacttcctggtatcggtagcgtaatgggcattgcagacggtgccgttcaccacaatacagaagagatagtggcacaatcaatagctttatcgtctttaatggttgctcaagctattccattggtaggagagctagttgatattggtttcgctccatataattttgtagagagtattatcaatttgtttcaagtagttcataattcgtataatcgttccgcgtattctccgg

SEQ ID NO: 289 - DNA, 818 bp, Corynebacterium diphtheriae, 38198900:8792-11362
gaagacctcatcgcccgcgagaacgtggtagtcaccatcacctccaccggctacgccaaacgcaccaaagtggacgcctacaagtcccagcgacgcggcggcaagggcgtacgcggcgccgagctcaaacaagacgacgtggtccgccacttctttgtcagctccacccacgactggatcctgttcttcaccaactttggtcgcgtctaccgactcaaagcctacgaactaccagaagcatcgcgcaccgcccgcggccagcacgtggccaacctgctggaattccagccggaagagcgcatcgcccaggtcattcaaatccagtcctacgaggatgccccctacctcgtactggcaaccgcgcagggtcgtgtgaagaagtcccgcctctccgactacgagtccaaccgctccggcggacttatcgccatcaacctcaacgaaggcgacaagctcatcggcgcagcactatgcgacaacgacgacgacctgctgctcgtctccgaagaaggccagtcgattcgcttcaacgccaacgacgaccaactgcgccccatgggccgtgctaccgcaggcgtgaagggtatgcgcttcaagggcgacgaccaactgctggcaatgacagtggtcaagccggatgcattcttgctggtagctacctccggcggctacggtaagcgcacctccttggatgaatactcaccacagggacgcggcggccagggcgtgcttaccttcaagtacacgccaaagcgtggcaagctcatcgccgcagttgttgttgacgaagacgacgagatcctagctatcacctccgc

SEQ ID NO: 290 - DNA, 1124 bp, Corynebacterium diphtheriae, M80336
aatgagtgctgttctcataagctaaccataaagtaatcttagagtagcgtataattaaggtctcatcgaaacggcccgctgcgggactgcaacttaacaagaaaacgattccgtattgttcacgctacaattcgttgtagattgataggaattgatcaccagcacccaacgcagtctccactggcattataaggaaagaggcttacaatgaaggacttagtcgataccacagagatgtacttgcgcactatctatgagctggaagaagagggagtcactccccttcgcgctaggatcgccgagcgtctggaacaatctggacctacagttagccaaaccgttgcccgtatggagcgcgatggacttgtcgttgtcgcctcagaccgtagtctacaaatgacgccaacaggtcgtacgttagcgactgcagtcatgcgtaagcatcgcttagcagagcgccttcttaccgatatcattggcctagatatcaataaagttcacgatgaagcctgccgatgggaacatgtcatgagcgacgaagttgagcgcaggctcgtgaaagtgctgaaagatgtcagcaggtcccccttcggaaacccgattccagggcttgacgaactaggcgtaggtaattccgacgcggcagcccccggaactcgcgtcatcgatgctgccacaagcatgccccgcaaagtacgcgttgttcagataaatgaaatcttccaagctgaaacggatcaattcacgcagctcctcgacgctgatatccgtgtcggtacagaagtcgaaatcgtggatagagacgggcatatcacgttgcgccacaatggaaaagatgtcgaactgtacgatgatctgactcacactatccgtatcgaagaactctaaatactaaatactaaaggcggcgaaattagctgaaactcctcgttaccggtggtgccgatacgtaggaagtgtctgttctacgcttctgctcgaacagggacacgaagtaacaattgtcgataatcttacaaccggcaatcgcgatgctgtcctctggagccactttgtcgaaggtgatatcaagacgtgcgagaacgttacaacttgatcttgacgcgtctaaaccttgcgcctgt

SEQ ID NO: 291 - DNA, 896 bp, Haemophilus influenzae, 1574717:c7221-4579
gaagatttaatcgcacaagaagacgtggttgtgacgctttctcacgaaggttatgtgaaataccaaccactgactgactatgaagcacaacgccgtggcggtaaaggcaaatctgcaacgaagatgaaagaagaagatttcatcgaaaaattactggtagcaaatactcacgataccatcctctgcttctctagccgtggtcgtttatattggttgaaagtatatcaacttccgcaagcgagccgtggcgcacgcggtcgtccaattgtgaatattcttccgttacaagaaaacgaacgtattactgcaatcttgccagtttctgcttacgaagaagataaattcgtagtcatggcaactgctggcggtattgtgaagaaaatcgccttaaccgaatttagccgtccacgttcaaacggtatcatcgcattgaatttacgtgacgaagatgaattaatcggcgtggatattactgatggcagcaacgaaattatgttgttctcatcacaaggtcgcgtggtgcgttttgctgaaaatgccgtgcgtgcgatggggcgtttagcaacaggtgttcgcggtatcaaactggctttaacaaacgatatttctgacgatgaaagtgcggtagaaattgaagatatttctgatgacaacgctgaagcatcattagacttaaatatcgataaagtggtctcgctcgttgtgccaaaaggtgaaggggcaattttaaccgcaacgcaaaacggctacggaaaacgcacacaattaagtgaatacccaactaaatcacgtaatacaaaaggtgtgatttcgattaaagtgagtgaacgcaatggtaaagtcgttgccgcaactcaagtagaagaaacagaccaaattatgttgatcactgatgc

SEQ ID NO: 292 - DNA, 937 bp, Haemophilus influenzae, L20309
gcgttaaagctggtcaagcatcttttcacgatggacttcgtgctctagctcgtgaaaagaatgttggttatcaccgtaattctttcacttatggtgtattcggtggttatcaaattttaaatcaaaataacttaggtttagcggttgaattaggttacgacgatttcggtcgtgctaaaggtcgtgaaaaaggtaaaactgttgctaaacacactaaccacggtgcgcacttaagcttaaaaggcagctatgaagtgttagacggtttagatgtttatggcaaagcaggtgttgctttagtacgttctgattataaattttatgaagatgcaaacggtactcgtgaccacaagaaaggtcgtcacacagcacgtgcctctggtttatttgcagtaggtgcagaatacgcagtattaccagaattagcagttcgtttagaataccaatggctaactcgcgtaggtaaataccgccctcaagataaaccaaataccgcaattaactacaacccttggattggttctatcaatgcgggtatttcttaccgttttggtcaaggcgcagcgccagttgttgcagcacctgaagttgtaagcaaaactttcagcttaaactctgatgtaactttcgcatttggtaaagcaaacttaaaacctcaagcacaagcaacattagacagcatctatggcgaaatgtcacaagttaaaagtgcaaaagtagctgttgctggttacactgaccgtattggttctgacgcgttcaacgtaaaactttctcaagaacgtgcagattcagtagctaactactttgttgctaaaggggttgcagcagacgcaatctctgcaactggctacggtaaagcaaacccagtaactggcgcaacttgtgaccaagttaaaggtcgtaaagcgcttatcgcttgtcttgctccagaccg

SEQ ID NO: 293 - DNA, 236 bp, Legionella pneumophilia, AY091594
gatgtcggtcattgtcggggatgtgataggtaagtaccaccctcatggtgatacggcagtttatgatacgattgttcgtatggcacagcctttttcgatgcgctatcttttggtagatggtcagggtaactttggctccgtggatggtgatgccccggcagcaatgaggtataccgaagtaagaatgtctaaagtcgcgcatgctttgttagctgatttggaaaaagagaccgtcg

SEQ ID NO: 294 - DNA, 1157 bp, Legionella pneumophilia, AF078136
gtccttacattggcttgaagtatgttggtaatgtgtaatttgttaagttgataagaaatttcagcaatactgttgactttatagaagtccggctggataatttatccaggtacgctctcgattagagcgaagaatgcgtactgttgctgatatgctaaattagtaacgaacggaaattaataataaaaaaagtggagataagcatgttaaatttgaaaaaaacagcggtagctgttcttgctttaggaagcagtgcagtgttcgctggtactatgggaccagtttgcaccccaggtaatgtaactgttccttgcgaaagaactgcatgggatattggtatcaccgcactatatttgcaaccaatctatgatgctgattggggctacaatggtttcacccaagttggtggctggcggcattggcatgatgttgaccatgagtgggattggggcttcaaattagaaggttcttatcacttcaatactggtaatgacatcaatgtgaactggtatcattttgataacgacagtgatcactggtttgattttgctaactggcacaactacaacaacaagtgggatgcagttaatgctgaactaggtcaattcgtagatttcagcgctaacaagaaaatgcgtttccatggcggtgttcaatatgctcgcattgaagctgatgtgaaccgttatttcaataactttgcgtttaacggattcaactccaagttcaacggctttggtcctcgcactggtttagacatgaactatgtatttggcaatggctttggtatttatgctaaaggagctgctgctattctggttggtaccagcgatttctatgatggaataggtttcgttactggttctaaaaatgccatcgttcctgagttggaagctaagcttggcgctgactacacttacgcaatggctcaaggcgatttgactttagacgttggttacatgtggtttaactacttcaacgctatgcacaatactgctactaatggtcttgaaactgatttcgcagcttctggtccttacattggcttgaagtatgttggtaatgtgtaatttgttaagttgataagaaatttcagcaatactgttgactttatagaagtccggctggataatttatccaggtacgctctcattaga

SEQ ID NO: 295 - DNA, 321 bp, Moraxella catarrhalis, AF056196
aactggaacaagccctacaagaaatccgcccgtgtggtcggcgacgtgatcggtaagtaccacccgcacggcgacatcgcggtctacgacaccatcgtgcgcatggcgcagccgttctcgctgcgctacatgctggtagacggccagggcaacttcggttcggtggacggcgacaacgccgcagccatgcgatacaccgaagtgcgcatggccaagctggcccatgaactgctggcggacctggaaaaggaaaccggtcgactgggtgccaactacgatggcaccgagcagatcccggcggtcatgccgaccaagattccc

SEQ ID NO: 296 - DNA, 653 bp, Moraxella catarrhalis, AY077637
gatcaatccatcgccatcggtacaggcaatgtggtagcaggtaagcactctggtgccatcggcgacccaagcactgttaaggctgataacagttacagtgtgggtaataacaaccagtttaccgatgccactcaaaccgatgtctttggtgtgggcaataacatcaccgtgaccgaaagtaactcggttgccctaggttcaaactctgccatcagtgcaggcacacacgcaggcacacaagccaaaaaatctgacggcacagcaggtacaaccaccacagcaggtgccacaggtacggttaaaggctttgctggacaaacggcggttggtgcggtctccgtgggtgcctcaggtgctgaacgccgtatccaaaatgtggcagcaggtgaggtcagtgccaccagcaccgatgcggtcaatggtagccagttgtacaaagccacccaaggcattgccaacgcaaccaatgagcttgaccatcgtatccaccaaaacgaaaataaagccaatgcagggatttcatcagcgatggcgatggcgtccatgccacaagcctacattcctggcagatccatggttaccgggggtattgccacccacaacggtcaaggtgcggtggcagtgggactgtcgaagctgtcggataatggtca

SEQ ID NO: 297 - DNA, 818 bp, Mycobacterium tuberculosis, 13879041:7302-9818
gaggatttgatcgcccgcgaggacgtcgttgtcactatcaccgaaacgggatacgccaagcgcaccaagaccgatctgtatcgcagccagaaacgcggcggcaagggcgtgcagggtgcggggttgaagcaggacgacatcgtcgcgcacttcttcgtgtgctccacccacgatttgatcctgttcttcaccacccagggacgggtttatcgggccaaggcctacgacttgcccgaggcctcccggacggcgcgcgggcagcacgtggccaacctgttagccttccagcccgaggaacgcatcgcccaggtcatccagattcgcggctacaccgacgccccgtacctggtgctggccactcgcaacgggctggtgaaaaagtccaagctgaccgacttcgactccaatcgctcgggcggaatcgtggcggtcaacctgcgcgacaacgacgagctggtcggtgcggtgctgtgttcggccgacgacgacctgctgctggtctcggccaacgggcagtccatcaggttctcggcgaccgacgaggcgctgcggccaatgggtcgtgccacctcgggtgtgcagggcatgcggttcaatatcgacgaccggctgctgtcgctgaacgtcgtgcgtgaaggcacctatctgctggtggcgacgtcagggggctatgcgaaacgtaccgcgatcgaggaatacccggtacagggccgcggcggtaaaggtgtgctgacggtcatgtacgaccgccggcgcggcaggttggttggggcgttgattgtcgacgacgacagcgagctgtatgccgtcacttccgg

SEQ ID NO: 298 - DNA, 932 bp, Mycobacterium tuberculosis, 38490207:318539-319519
gacgaactcagaaattctaccggggctcgccgggccgtccgtggctgattggcgcggtggttattccgttgctgatagcggcaatcggttacggtgcattcgagcggccccagtccgttaccggaccgaccggtgtgttgccgacactgacaccgaccagcacccggggcgcttctgcgttgtccttgtctttgctgtcaattagccgcagcggcaacaccgttactctgatcggtgacttccccgatgaggccgccaaggcggccttgatgacggcgctcaacggcttgcttgctccgggcgtgaacgtcatcgaccagattcacgtcgatcccgttgtgcgatcacttgatttctcaagtgcggaaccagttttcaccgccagcgtgccgattcctgattttggcctcaaagtcgaaagggacaccgtcaccttgaccggaactgccccttcatccgagcacaaggacgcagtgaagcgcgcggcgaccagcacctggcctgacatgaaaatcgttaacaatattgaggttacggggcaggcaccgccaggacccccggcctccggcccatgtgccgacctgcaatcagccatcaatgccgtgacgggtggacccatcgcgtttggcaacgacggggctagtctgatcccagccgactatgaaatcctgaaccgggtagccgacaagctcaaggcatgtccggacgctcgggtgacgatcaacggctacaccgacaacaccggcagcgaaggtatcaatatcccgttgagcgctcagcgagccaagatagtcgccgactacctggttgcccgcggagttgccggcgatcacattgccaccgtgggtctcggttcggtgaatccgatcgccagcaacgccacacccgaggggcgcgccaagaatcgtcgcgtcgagatcgtggtcaactaa

SEQ ID NO: 299 - DNA, 411 bp, Mycobacterium tuberculosis, 468333:1065-4598
tacggtcggcgagctgatccaaaaccagatccgggtcggcatgtcgcggatggagcgggtggtccgggagcggatgaccacccaggacgtggaggcgatcacaccgcagacgttgatcaacatccggccggtggtcgccgcgatcaaggagttcttcggcaccagccagctgagccaattcatggaccagaacaacccgctgtcggggttgacccacaagcgccgactgtcggcgctggggcccggcggtctgtcacgtgagcgtgccgggctggaggtccgcgacgtgcacccgtcgcactacggccggatgtgcccgatcgaaacccctgaggggcccaacatcggtctgatcggctcgctgtcggtgtacgcgcgggtcaacccgttcgggttcatcgaaacgccgta

SEQ ID NO: 300 - DNA, 809 bp, Mycoplasma pneumoniae, 11379479:4821-7340
gaggacttaattacccaggaaaacgtggtaatcacgatgtccactaacggttatctcaaacggattggggtagacgcttataacctgcaacaccgtggtggggtgggtgttaagggtttaactacctacaccgatgacagtattagccagctgttagtctgctcgacccactcggacctcttattctttacggacaagggaaaggtctaccgcatccgggcccaccaaattcccccgggttttcgtactaacaaggggattccggcggttaacctgattaagatcgacaaggacgagaagatctgtgccttaatttcggtgaatgattaccaaaatggttacttcttcttttgtaccaagaacggtaccattaagcgcaccagtctaagtgagtttgccaacatcttgagtattggtaaacgcgccatcctctttaaggaaaacgatgttttgttctcggttattcgcaccagtggtcaagatgacatctttatcggttcgaccgcggggtttgtcgtgcgtttccacgaagacaccgtccgtccgctgtcccgcgctgccatgggggtcttggggattaatctcaaccagtgcgaatttgtcaatggtctgtccacttccagtaacgggagtttattactctctgtgggtcaaaatggcattggtaagctcaccagtattgacaaatatcgtttaaccaagcggaatgctaagggagttaaaacactacgagtaactgctaaaactggtccggttgtgaccactacgaccgtctttggtaacgaagatttgttaatgatttcttcagc

SEQ ID NO: 301 - DNA, 2520 bp, Mycoplasma pneumoniae, AF290002
cagttgcagcgggggttagcgctccctaaccaagggagttcgtcaggctcagacagcactaaccaaacaggcgcaatgtttggcttgaaggtgaaggatgcaaccgtggatagttcgaagcaatcaacggaaagcttaaagggcgaagaatcgagttccagttccaccacatcttccacctccaccacccaacgtgggggttcgtcaaatgaaaacaaagtcaaggcgttgcaggtggcggtgaaaaagaaatccgggagtcagggcaactccggtgaccaaggcaccgaacaggtggaacttgaatctaatgatttagccaacgccccgattaaacggggctccaataacaaccagcaagtccaactcaaggcggacgattttggtactgccccttccagttcgggatcaggcacccaagatggcacccccaccccctgaacgccgtggttaacgactgagcaaattcacaacgaccccgccaaattcgccgcctcgatcctgattctgtacgatgcgccttatgcgcgcaaccgtaccgccattgaccgcgttgatcacttggatcccaaggccatgaccgcgaactatccgcccagttgaagaacgcccaagtgaaaccaccacggtttgtgggactgaaaggcgcgcgatgttttgctccaaaccaccgggttcttcaacccgcgccgccaccccgagtggtttgatggcgggcagacggtcgcggataacgaaaagaccgggtttgatgtggataactctgaaaacaccaagcagggctttcaaaaggaagctgactccgacaagtcggccccgatcgccctcccgtttgaagcgtacttcgccaacattggcaacctcacctggttcgggcaagcgcttttggtgtttggtggcaatggccatgttaccaagtcggcccacaccgcgcctttgagtataggtgtctttagggtgcgctataatgcaactggtaccagtgctactgtaactggttgaccatatgccttactgttctcaggcatggtcaacaaacaaactgacgggttaaagaatctaccctttaacaataaccgctggtttgaatatgtaccacggatggcagttgctggcgctaagttcgttggtagggaactcgttttagcgggtaccattaccatgggtgataccgctaccgtacctcgcttactgtacgatgaacttgaaagcaacctgaacttagtagcgcaaggccaaggtcttttacgcgaagacttgcaactcttcacaccctacggatgagccaatcgtccggatttaccaatcggggcttgaagtagtagtagtagtagtagtcacaacgcaccctactacttccacaataaccccgattgacaagaccgtccaatccaaagtgtggttgatgcctttattaagccctgagaggacaagaacggtaaggatgatgccaaatacatctacccttaccgttacagtggcatgtgagcttgacaggtatacaactggtccaataagctcactgaccaaccattaagtgctgactttgtcaatgagaatgcttaccaaccaaactccttgtttgctgctattctcaatccggaattgttagcagctcttcccgacaaggttaaatacggtaaggaaaacgagtttgctgctaacgagtacgagcgctttaaccagaagttaacggtagctcctacccaaggaacaaactgatcccacttctcccccacgctttcccgtttctccaccgggttcaaccttgtggggtcggtgctcgaccaggtgttggattatgtgccctggattgggaatgggtacaggtatggcaataaccaccggggcgtggatgatataaccgcgcctcaaaccagcgcggggtcgtccagcggaattagtacgaacacaagtggttcgcgttcctctctcccgacgttttccaacatcggcgtcggcctcaaagcgaatgtccaagccaccctcgggggcagtcagacgatgattacaggcggttcgcctcgaagaaccctcgaccaagccaacctccagctctgaacgggggcggggtgaaggaatgataaggcttcaagtggacaaagtgacgaccacaccaagttcacgagcgctacggggatgggccagcaggaacaatcaggtacctccgcggggaatcccgactcgttaaagcaggataagattagtaagagtggggatagtttaaccacgcaggacggcaatgcgatggaacaacaagaggccaccaactacaccaacctcccccccaacctcacccccaccgctgattgaccgaacgcgctgtcattcaccaacaagaacaacgcgcagcgcgcccagctgttcctgcgcggcctgttgggcagcatcccggtgttggttaataagtccggccaagatgataacagtaagtttaaggcggaggaccaaaaatggtcctacaccgacttacagtcggaccaaaccaaactgaacctccccgcttacggtgaggtgaat

SEQ ID NO: 302 - DNA, 941 bp, Neisseria meningitidis, 7413466:89-2839
gaagacctgattccgcaacgcgaaatggtcgttaccctgacacatggcggctatatcaaaacccagccgaccaccgactatcaggcgcagcgtcgcggcgggcgcggcaaacaggcggctgccaccaaagacgaagactttatcgaaaccctgtttgttgccaacacgcatgattatttgatgtgctttaccaatttgggcaagtgtcattggattaaggtttacaaactgcccgaaggcggacgcaacagccgcggccgtccgattaacaacgtcatccagttggaagaaggcgaaaaagtcagcgcgattctggcagtacgcgagttccccgaagaccaatacgtcttcttcgccaccgcgcagggaatggtgaaaaaagtccaactttccgcctttaaaaacgtccgcgcccaaggcattaaagccatcgcgctcaaagaaggcgactacctcgtcggcgctgcgcaaacaggcggtgcggacgacatcatgctgttctccaacttaggtaaagccatccgcttcaacgaatactgggaaaaatccggcaacgacgaagcggaagatgccgacatcgaaaccgaaatttcagacggcatcgaagatgaaaccgccgacagcgaaaacgcactgccgagcggcaaacacggtgttcgcccgtccggtcgcggcagcggcggtttgcgcggtatgcgcctgcctgccgacggcaaaatcgtcagcctgattaccttcgcccctgaaaccgaagaaagcggtttgcaagttttaaccgccaccgccaacggatacggaaaacgcaccccgattgccgattacagccgcaaaaacaaaggcgggcaaggcaatattgccattaacactggcgagcgaaacggcgatttggtcgccgcaaccttggtcggcgaaaccgacgatttgatgctgattaccagcgg

SEQ ID NO: 303 - DNA, 904 bp, Neisseria meningitidis, 7225498:c5929-4388
gatgaatatgctgggagctttggcaaaagtcggcagcctgacgatggtgtcgcgcgttttgggatttgtgcgcgatacggtcattgcgcgggcattcggcgcgggtatggcgacggatgcgttttttgtcgcgttcaaactgcccaacctgcttcgccgcgtgtttgcggagggggcgtttgcccaagcgtttgtgccgattttggcggaatacaaggaaacgcgttcaaaagaggcggcggaggcttttatccgccatgtggcggggatgctgtcgtttgtactggttatcgttaccgcgctgggcatacttgccgcgccttgggtgatttatgtttccgcacccggttttgcccaagatgccgacaaatttcagctctccatcgatttgctgcggattacgtttccttatatattattgatttccctgtcttcatttgtcggctcggtactcaattcttatcataagttcggcattccggcgtttacgcccacgtttctgaacgtgtcgtttatcgtattcgcgctgtttttcgtgccgtatttcgatccgcccgttaccgcgctggcgtgggcggtctttgtcggcggcattttgcaactcggcttccaactgccctggctggcgaaactgggctttttgaaactgcccaaactgagtttcaaagatgcggcggtcaaccgcgtgatgaaacagatggcgcctgcgattttgggcgtgagcgtggcgcaggtttctttggtgatcaacacgattttcgcgtcttatctgcaatcgggcagcgtttcatggatgtattacgccgaccgcatgatggagctgcccagcggcgtgctgggggcggcactcggtacgattttgctgccgactttgtccaaacactcggcaaaccaagatacggaa

SEQ ID NO: 304 - DNA, 135 bp, Neisseria meningitides; identical to SEQ ID NO: 38

SEQ ID NO: 305 - DNA, 254 bp, Neisseria meningitidis; identical to SEQ ID NO: 39

SEQ ID NO: 306 - DNA, 1489 bp, Arcanobacterium hemolyticum, X73952
cgaacgctggcggcgtgcttaacacatgcaagtcgaacgatgaaggctcctgcttgcggggttggattactgcgaacgggtgagtaacacgtgagtaacctgcccttctcttgggataagccttggaaacgaggtctaatactagatattctgcttctgccgcatggagggggttggaaaggttttttctggtgggggatgggctcacggcctatcagcttgttggtggggtgatggcctaccaaggcgtcgacgggtagccggcctgagagggtgaccggccacattgggactgagatacggcccagactcctacgggaggcagcagtggggaatattgcacaatggacggaagtctgatgcagcgacgccgcgtgggggatgaaggctttcgggttgtaaactccttttaacactgaacaaggcgaaagttgagggtaggttgtgaataagcgccggctaagcgccggctaactacgtgccagcagccgcggtaatacgtagggcgcgagcgttgtccggaattattgggcgtaaagagctcgtaggcggtttgtcgcgtctgctgtgaaagaccggggcttaactccggggctgcagtgggtacgggcaggctagagtgcggtaggggtaattggaattcctggtgtagcggtggaatgcgcagatatcaggaggaacaccaatggcgaaggcaggttactgggccgttactgacgctgaggagcgaaagcatggggagcgaacaggattagataccctggtagtccatgccgtaaacgttgggcactaggtgtggggccttttccatgggttctgtaccctagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcaccgggattatgcagagatgtgtgagtcttcggactggtgtacaggtggtgcatggctgtcgtcagctcgtgtcgtgagatgttgggttaagtcccgcaacgagcgcaacccttgtcttgtgttgccagcacgttatggtggggactcacgagagactgccggggttaactcggaggaaggtggggatgacgtcaaatcatcatgccccttatgtcttgggcttcacgcatgctacaatggctggtacagagggttgcgagcttgtgagggtgagcgaatcccttaaagccagtctcagttcggattggggtctgcaactcgaccccatgaagtcggagtcgctagtaatcgcagatcagccaacgctgcggtgaatacgttcccgggctttgtacacaccgcccgtcacgtcacgaaagttggtaacacccgaagcccgtggcctaactcgtttgagggggagcggacgaaggtgggattagccattgggacgaagtcgtaacaaggtagccgtaccggaagg

SEQ ID NO: 307 - DNA, 1111 bp, Arcanobacterium hemolyticum, L16583
gcaaagtgtaacggtcaacatagagacatggaagagaacaccacaggttctgaaaaacattgtgaatatttctctttcatcatataaatacacaattttatccttaaccggatgggcttcgcagaaagatgtacgacgatgaagacgcggaaaaaaattgctttagccttgtcgcttctcacgggatttatgctaccaattggtagtgcggctgctgcgccacttgcgcaagaacaaccaaccactggtaaccgtccagtctatgccattgcgcaccgtgttctgacgaagcaaagtgtcgatgacgcaatcaaaattggcgcgaacgctctggaaattgattttactgcgtggcgccgtggctggtgggctgaccatgacgggcttccaactagtgctggcgatacggcagaagacattcttaagtacatcgctcaaaagcgtcgcgaaggtaataacattacatttgtctggtttgatattaagaacccagattattgtaaggaccaaaatagtgtgtgttcaattacgaagctaagagatctcgcacggcaaacgattgaacaagaaggcgtcagagctctctttggcttctataagacagtcggaggtgtcggctggaatactattgctaataatctcaacgacaaggaagcagttgctctcagtggccgaaaagatgacatcatgaaggacttcaagcagtacgaaaataagatcaaacctcagcaacgcgtcgctgataacggttactacaaccttagctacggcttcggtggttgctaccgagatgagaatcagacgtgtgatcagctgcgtcttgctggagaagaacgcaaaaaggggaatctaggaaagaccttcggatggaccgtcagtactggacaggaatacctggctgcagatcttctgaataaggcagaagttgatggaatgatcttcggatttaagaccacctacttctatgatcacgccgatactcgcaatgcttttgctggaattaagaactgggtggatgcacatcaaggtactcaccacatggcaaccaacaaagacattccgtggtgatcgaatgagataacactaaaccttatatctagcctctcctttt

SEQ ID NO: 308 - DNA, 732 bp, Bacillus anthracis, AY291534
gaagacttgattccagaacaaaacatcgccattacgttaactcataatggttatattaagaggttgccagcttctacgtacaaaacacagaaccgtggtggacgtggtgtgcagggaatgggaacaaatgatgatgatttcgtagagcatttattaaccacttctacgcatgaccatattctattcttcactaataaagggaaagtataccgtacgaaaggatatgaaatcccagagtatagtcgtacagcgaaaggtatacctattattaacttattaggtgtagataagggtgaatggattaacgccattattccaattcgtgaatttggtgacgatgaattcttattcttcacaacaaaacaaggtatctctaagagaacaccactttcatcatttgcgaatatacgtacaaatggtttaattgcaatctctcttcgtgaagaggatgaagtaatatctgtacgtttaacatctggtgataaggatattattgtaggtacaagcaatggtatgctaattcgttttaacgagcaagatgtacgttctatgggacgtaatgcggctggtgtaaaagcaattacattaggtgaagaagatcaagttgtaggtatggaaattgtcgaagaggatgtaaatgttttaattgtaacgaaaaatggttatggaaaacgtactccgattgatgaatatcgcttgcaaagccgtggtggtaaaggtctgaagacttgt

SEQ ID NO: 309 - DNA, 685 bp, Bacillus anthracis, M29081
atatcgagccacagcatcgtgatgttttacagctttatgcaccggaagcttttaattacatggataaatttaacgaacaagaaataaatctatccttggaagaacttaaagatcaacggatgctgtcaagatatgaaaaatgggaaaagataaaacagcactatcaacactggagcgattctttatctgaagaaggaagaggacttttaaaaaagctgcagattcctattgagccaaagaaagatgacataattcattctttatctcaagaagaaaaagagcttctaaaaagaatacaaattgatagtagtgattttttatctactgaggaaaaagagtttttaaaaaagctacaaattgatattcgtgattctttatctgaagaagaaaaagagcttttaaatagaatacaggtggatagtagtaatcctttatctgaaaaagaaaaagagtttttaaaaaagctgaaacttgatattcaaccatatgatattaatcaaaggttgcaagatacaggagggttaattgatagtccgtcaattaatcttgatgtaagaaagcagtataaaagggatattcaaaatattgatgctttattacatcaatccattggaagtaccttgtacaataaaatttatttgtatgaaaatatgaatatcaataaccttacagcaaccctaggtgc

SEQ ID NO: 310 - DNA, 599 bp, Bacillus anthracis, AF306783
cagaagtgcatgcgtcgttctttgatattggtgggagtgtatctgcaggatttagtaattcgaattcaagtacggtcgcaattgatcattcactatctctagcaggggaaagaacttgggctgaaacaatgggtttaaataccgctgatacagcaagattaaatgccaatattagatatgtaaatactgggacggctccaatctacaacgtgttaccaacgacttcgttagtgttaggaaaaaatcaaacactcgcgacaattaaagctaaggaaaaccaattaagtcaaatacttgcacctaataattattatccttctaaaaacttggcgccaatcgcattaaatgcacaagacgatttcagttctactccaattacaatgaattacaatcaatttcttgagttagaaaaaacgaaacaattaagattagatacggatcaagtatatgggaatatagcaacatacaattttgaaaatggaagagtgagggtggatacaggctcgaactggagtgaagtgttaccgcaaattcaagaaacaactgcacgtatcatttttaatggaaaagatttaaatctggtagaaaggcggatagcg

SEQ ID NO: 311 - DNA, 777 bp, Bacillus anthracis, AF205335
tagttcgctctccaagcgtatactatagtggcaaagtggataaaaacggaaaacgtggttttactgctactgtaattccaaaccgcggagcttggttagagtatgagacagatgctaaggatgttgtatatgtgcgtattgaccgtacgcgtaaacttcctgtaactgttttgttacgcgcattagggtttggctctgatcaagaaatcaccgagcttttaggtgataacgaatacttaagcaacacattagaaaaagacaacacagatagcacagaaaaagcattgcttgaaatttatgagcgtctacgtcctggtgaaccaccaacagtagaaaatgccaagagcttacttgtgtctcgtttcttcgatccaaagcgctatgatttagcaaatgtaggtcgctacaagatcaacaagaagttacacattaaaaacagattgtttaaccaacgtttagctgaaacattagtagatccagaaactggtgaaattttagcggcagaaggaacaatcttagatcgtcgtacacttgatcgcattttaccttacttagagaaaaacattggattcaaaacagcgaaaccaatgggtggagtggtagaaggtgatgttgagctgcaatctattaagatttatgctcctgagtcagaaggcgagcgcgtaattaatgtaattggtaatgcaaacattactcgtgatgtaaaacacatcacaccaggtgatatccttgcttctatcagttacttcttcaacttactatacaaagtaggggata

SEQ ID NO: 312 - DNA, 545 bp, Bacillus anthracis, 142812:544-2946
gcgatgatagtgatagtagcgaccttttatttagtcaaaaatttaaagagaagctagaattgaataataaaagtatagatataaattttataaaagaaaatttaactgaatttcagcatgcgttttctttagcgttttcttattattttgcacctgaccatagaacggtattagagttatatgcccccgacatgtttgagtatatgaataagttagaaaaagggggatttgagaaaataagtgaaagtttgaagaaagaaggtgtggaaaaagataggattgatgtgctgaaaggagaaaaagcacttaaagcttcaggtttagtaccagaacatgcagatgcttttaaaaaaattgctagagaattaaatacatatattctttttaggcctgttaataagttagctacaaaccttattaaaagtggtgtggctacaaagggattgaatgaacatggaaagagttcggattggggccctgtagctggatacataccatttgatcaagatttatctaagaagcatggtcaacaattagctgtcgag

SEQ ID NO: 313 - DNA, 246 bp, Bacillus anthracis; identical to SEQ ID NO: 47

SEQ ID NO: 314 - DNA, 777 bp, Bacillus cereus, AF205342
tagttcgctctccaagcgtatactatagtggcaaagtggataaaaacggaaaacgtggttttactgctactgtaattccaaaccgcggagcttggttagagtatgagacagatgctaaggatgttgtatatgtgcgtattgaccgtacgcgtaaacttcctgtaactgttttgttacgcgcattagggtttggctctgatcaagaaatcaccgagcttttaggtgataacgaatacttaagcaacacattagaaaaagacaacacagatagcacagaaaaagcattgcttgaaatttatgagcgtctacgtcctggtgaaccaccaacagtagaaaatgctaagagcttacttgtgtctggtttctttgatccaaagcgctacgatttagcaaatgtaggtcgctataagatcaacaagaagttacacattaaaaacagattgtttaatcaacgtttagctgaaacattagtggatccagaaactggtgaaattttagcggcagaaggaacaatcttagatcgtcgtacacttgatcgcattttaccttacttagagaaaaacattggattcaaaacagcgaaaccaatgggtggagtggtagaaggcgatgttgagctgcaatctattaagatttatgctcctgagtcggaaggcgaacgcgtaattaatgtaattggtaatgcaaacattactcgtgatgtgaaacacatcacaccaggtgatatccttgcttctatcagttacttcttcaacctactatacaaagtaggggata

SEQ ID NO: 315 - DNA, 812 bp, Bacillus subtillus, 40012:7769-10234
gaagatctcatcgagagagaaaatatcgtagttactctgacgcacaacggatacgtcaaacgtcttcctgcatcaacttaccgcagtcaaaaacggggcggaaaaggtgtacaaggtatgggaacaaacgaagatgatttcgttgaacatttgatctctacgtcaactcatgacacgattctcttcttctcgaacaaggggaaagtgtatcgtgcaaaagggtatgaaatccctgaatacggcagaacggcaaaaggaatcccgattattaacctgctggaggtagaaaagggtgagtggatcaacgcgattattccagtcacggaattcaatgcggagctttacctcttcttcactacaaagcatggggtttcaaaacgaacatcgctatctcaattcgctaatatccgcaacaatggtctaattgctctgagtcttcgtgaagatgatgaactgatgggtgtacgtctgactgacggcacaaaacaaatcatcattggaacgaaaaacggtttactgattcgtttccctgaaacagatgtccgagagatgggaagaactgcggcgggcgtaaaaggcatcaccctgacggatgacgacgttgttgtcggcatggagattttagaggaagaatcacacgtccttatcgtaactgaaaaagggtacggaaaacgaactcctgctgaagagtacagaacccaaagccggggcggaaaaggactcaaaacagcgaaaatcaccgagaacaacggccaactagtagcagtgaaagctactaaaggtgaagaggatctaatgattattacagctag

SEQ ID NO: 316 - DNA, 780 bp, Bacillus subtillus, AF205356
ttgttcggtctccaagtgtatatttcagtggtaaagtagacaaaaacggtaaaaaaggttttaccgcaactgtcattccaaaccgtggcgcatggttagaatacgaaactgatgcgaaagatgttgtttatgtccgcattgatcgcacacgtaagttgccggttacggttcttttgcgtgctctcggcttcggctccgatcaagagattcttgatctcataggagaaaacgaatacctgcgaaatacgcttgataaagataacacagaaaacagcgacaaagcgttgctggaaatttacgagcgtctccgtcctggagagccgcctacagtagaaaatgcgaaaagcttgcttgattctcgtttctttgatccgaaacgatacgatcttgccaatgtaggacgctataaaattaataaaaaacttcatattaagaatcgcctcttcaatcagagacttgctgaaacgcttgttgatcctgaaacaggagaaatccttgctgaaaaaggccagattcttgatagaagaacgcttgataaagtactgccatacttagaaaacggaatcggttttagaaagctgtatccgaatggcggcgttgttgaagatgaagtgactcttcaatcaattaaaatctttgctccgactgatcaagaaggagaacaggttatcaatgtaatcggcaatgcttacatcgaagaagagattaaaaacatcacgcctgctgatattatttcttcaatcagctacttcttcaacctgctgcacggagtaggcgaca

SEQ ID NO: 317 - DNA, 853 bp, Bacillus thuringensis, AF278797
agaacacaagggctaggagtgttgtcaagagccaatatatcgcattagaattgatgttcgttcagaaactaccttcttttgcagtgtctggagaggaggtaccattattaccgatatatgcccaagctgcaaatttacatttgttgctattaagagatgcatctatttttggaaaagagtggggattatcatcttcagaaatttcaacattttataaccgtcaagtcgaacgagcaggagattattccgaccattgtgtgaaatggtatagtacaggtctaaataacttgaggggtacaaatgccgaaagctgggttcgttataatcaatttcgtaaagatatgacattaatggtacttgatttagtcgcactattcccaagctatgatacacttgtatatccaattaaaactacttctcaacttacaagagaagtatatacagacgcaattgggacagtacatccgaatgcaagttttgcaagtacgacttggtataataataatgccccttcgttctctaccatagagtctgctgttgttcgaaacccgcatctactcgattttctagaacaagttacaatttacagcttattaagtaggtggagtaacactcagtatatgaatatgtggggaggacatagacttgaattccgaacaatcggaggaatgttaaatacctcaacacaaggatctactaatacttctattaatcctgtaacattaccgttcacgtctcgagacgtctataggactgaatcattggcagggctgaatctatttttaactcaacctgttaatggagtacctagggttgattttcattggaaattcgtcacacatccgatcgcatc

SEQ ID NO: 318 - DNA, 777 bp, Bacillus thuringensis, AF205349
tagttcgctctccaagcgtatactatagtggcaaagtggataaaaacggaaaacgtggttttactgctactgtaattccaaaccgcggagcttggttagagtatgagacagatgctaaggatgttgtatatgtgcgtattgaccgtacgcgtaaacttcctgtaactgttttgttacgcgcattagggtttggctctgatcaagaaatcaccgagcttttaggtgataacgaatacttaagcaacacattagaaaaagacaacacagatagcacagaaaaagcattgcttgaaatttatgagcgtctacgtcctggtgagccaccaacagtagaaaatgctaagagcttacttgtgtctcgtttctttgatccaaagcgctacgatttagcaaatgtaggtcgctacaagatcaacaaaaagttacacattaaaaacagattgtttaatcaacgtttagctgaaacattagtggatccagaaactggtgaaattttagcggcagaaggaacaatcttagatcgtcgtacacttgatcgcattttaccttacttagagaaaaacattggattcaaaacagcgaaaccaatgggtggagtggtagaaggagatgttgagctgcaatctattaagatttatgctcctgagtcagaaggcgagcgcgtaattaaagtaattggtaatgcaaaaattactcgtgatgtaaaacacatcacaccaggtgatatccttgcttctatcagttacttcttcaacctactatacaaagtaggggata

SEQ ID NO: 319 - DNA, 815 bp, Bordetella pertussis, 33571514:286253-288934
gaagacctgatcacgccgatggacatggtggtcaccctgtcgcatggcggatacatcaagagccagccgctgtccgagtaccgttcgcaaaagcgcggcggacgcggcaagcaggctaccgccatgaaggagaacgactgggtcgaccagctgttcatcgccaatacgcacgactacctgctgtgcttctccaaccggggccgggtgtactggctgaaggtgtgggaggtgccgcagggcacgcgcaactcgcgcggcaagcccatcgtcaacatgttcccgctggccgacggcgagaaggtgaccgtggtgctgccggtcaaggaattcagcgaagaccactacgtcttcatggcgacgtcgcgcggcacggtcaagaagaccccgctgtccgacttctcgaacccgcgcaaggccggcatcatcgccgtcgacctggatgacggcgattacctgatcggcgcagacctgaccgacggcaagcacgatgtgatgttgttctccgacgccggcaaggcggtgcgcttcgacgagaacgacgtgcgtccgatgggccgcaatgcgcgcggcgtgcgcggcatgatgctcgaagagggccagaccgtcatcgcgctgctggtggccggcgacgagacccagagcgtgctgaccgccaccgagaacggctacggcaagcgcaccccgatcaccgagtacacccgccatggccgcggcaccaagggcatgatcgccatccagaccagctcgcgcaacggccgcgtggtcggcgccgtgctggtgatgccgtccgacgagatcatgctgatcaccaccgg

SEQ ID NO: 320 - DNA, 777 bp, Bordetella pertussis, AJ507642
ggttcaaggtcctgacggtcaatacgctggcgggttcggggctgttccgcatgaatgtcttcgcggacctggggctgagcgacaagctggtcgtcatgcaggacgccagcggccagcacaggctgtgggtccgcaacagcggcagcgagccggccagcgccaacaccctgctgctggtgcagacgccactaggcagcgcggcgacctttacccttgccaacaaggacggcaaggtcgatatcggtacctatcgctatcgattggccgccaacggcaatgggcagtggagcctggtgggcgcgaaggcgccgccggcgcccaagcccgcgccgcagccgggtccccagccgccgcagccgccgcagccgcagccggaagcgccggcgccgcaaccgccggcgggcagggagttgtccgccgccgccaacgcggcggtcaacacgggtggggtgggcctggccagcacgctctggtacgccgaaagcaatgcgttgtccaagcgcctgggcgagttgcgcctgaatccggacgccggcggcgcctggggccgcggcttcgcgcaacgccagcagctggacaaccgcgccgggcggcgcttcgaccagaaggtggccggcttcgagctgggcgccgaccacgcggtggcggtggccggcggacgctggcacctgggcgggctggccggctatacgcgcggcgaccgcggcttcaccggcgacggcggcggccacaccgacagcgtgcatgtcgggggctatgccacatatatcgccgaca

SEQ ID NO: 321 - DNA, 995 bp, Brucella melitensis (F6145), AE009529:4650-7358
gaagacctgattgcccgcgaggatatggtcgtcaccgtcagtcatgcaggctatatcaagcgcgtaccgctcacgacctatcgtgcgcagcgccgcggcggcaagggccgttccggcatggccaccaaggaagaagattttgtgacccgcctgttcgtggccaacacgcatacgccggttctgttcttctcgtcgcgcggtatcgtttacaaggaaaagctgtggcgtctgccggtcggcacgccgcaatcgcgtggcaaggcgctcatcaatatgctgccattgcagcagggcgagcgtatcaccaccatcatgccgctgccggaggatgaggattcctgggcgaacctcgacgtgatgttctcgaccacgcgcggcacggttcgccgcaacaagctgtcggacttcgtgcaggtcaatcgcaacggcaagatcgcaatgaagctcgaagacgagggcgatgaaatcctctcggtcgatacctgtacggaattcgacgatgtgctgctgacatgtgccggtggccagtgcatccgcttccccgttaccgatgtgcgcgtctttgctggccgcaattctatcggtgtgcgcgggatcaatctggcagagggcgacaaggtcatttcgatggcgatcctgcatcatgtcgatgcaacgccggcggagcgttccgcctatctcaagcgttcgattgcagagcgcagggcacagggcgctgacgatgcggatgatatcgttgttgtcggcgaggatgtcgatgcagaagcggagctgtcggaagatcggtatcaggagttgaaggctcgtgaggaaaccgtgctgacggtcagcgaattcggctacggcaagcgttcttcgtcttacgagttccgcatttcgggccgcggcggcaagggcatccgtgccacagatacgtcgaagaccgatgaaatcggcaagcttgtggcgctgttccctgttgagggaagcgatcagattctgcttgtttcggatgg

SEQ ID NO: 322 - DNA, 1339 bp, Brucella abortus (RB51), AF107768
atcccatatatgctgcttcgaccgcagcaaaagttccgttgtctgccaaagttggatgccaaaagaaacaagctgaagcaagaagctccgcatactccttgtccgcaacctcaccagcgaactcaacattgcttttcaggttgtcgagacccgcaacaatttcccgtacagatttcacataagccttattttcgtacttggcctgccatcgatgggatgggtccatccgcacactactcacaccgactatctttgtctttatcttaccctttagtttgccgtaatataggtctagaacctgtctgcaatcgaggattcccttttgtacgaaattctgattcaaggttgttgaaggagaacagccttgagcagacgaagccttacagatgagcaatggaaccggatcgaagcatatcttccggggcgagttggtacgcccggccgcagtggcgttgataaccgattatttgtcgacgccatcttgtggatggctgccaatgcagcgcactggcgcgatctgcctgcgaccttcggcaaatggacagcggttcatgcccgctttcggcgctggtcgcacgccggtgtatgggaaaggcttttccatgccctggctgatacgccggactttgaatatgtcctcattgatagcaccatatcgaaagtccacgcagatgcggcgggcgcaaaaggggggctgaagctgcctgcatcggtcgctcgcgcggtggattgacgaccaagctgcatgctgttgtcgatgctatcggcctaccgctgcgaataaagccaacacccggccattatggtgactgtccgcaagcttcaagccttctatccggcttgaagggtgtggggcatgtcattgctgatgcagcctatgatgccgatcacttaagggccttcattgccagcgatctcaaggcaacggctcagatcaaggccaatccaacacgttccagtgccccaacaatcgactggaggctgtacaaggaacgccatcagattgaatgcttttttaacaagttgaaacgctatcgtcgcattgcgctgcgatgcgagaaaacattgaccgcattcatgggtttcgtccatctcgcatgcgctatgatctggttgcgttgaatgcagacacgccctagcgcttgaaacgcttttgcatggtttttgtgagcatttgggttggttggccaaaggaaatagggttccttaaccttagacactgaccggtaacgatccaaaaacgtcgggtcaaactccatcggagcaagataaactttggacgcaggtaagccagcgtatgaaatcgcatccagccgcgtgtgtggtgttgtagctagta

SEQ ID NO: 323 - DNA, 630 bp, Brucella abortus (2308 B37), X79284
aagtctctcgtaatcgtctcggctgcgctgctgccgttctctgcgaccgcttttgctgccgacgccatccaggaacagcctccggttccggctccggttgaagtagctccccagtatagctgggctggtggctataccggtctttaccttggctatggctggaacaaggccaagaccagcaccgttggcagcatcaagcctgacgattggaaggctggcgcctttgctggctggaacttccagcaggaccagatcgtatacggtgttgaaggtgatgcaggttattcctgggccaagaagtccaaggacggcctggaagtcaagcagggctttgaaggctcgctcggtgcccgcgtcggctacgacctgaacccggttatgccgtacctcacggctggtattgccggttcgcagatcaagcttaacaacggcttggacgacgaaagcaagttccgcgtgggttggacggctggtgccggtctcgaagccaagctgacggacaacatcctcggccgcgttgagtaccgttacacccagtacggcaacaagaactatgatctggccggtacgactgttcgcaacaagctggacacgcaggatatccgcgtcggcatcggctacaagttctaa

SEQ ID NO: 324 - DNA, 1434 bp, Brucella abortus (2308 B37), U26438
tgttcttccactcgccaccaaacttggtgtaggaaacttccggcgtaacggtgaagccaggaaccagttcgtaagcaacgttagccgtaactgccgtcttgccccagtcgtcatgcgcagcctgcaggttgaaggcagccttctgcgtagcctgatacttcagaccaccccagacagcccaatcgccgccccactggccgtagttctgatccggcgtagcagcggacgaatatgcgccctgcaaccaaaccgagaactggtcggtgatgttgacgtcgccacgaaccttggcagcccattcttcgatgaccgagtcataggcaacaacaccagcgatcgaaccccagccgccagcatacttcaggccgccaacaacgtcaggcatgtagccgtcgatgtggtagttggtcgtgccagtgtaaccaccgtcgttgtcgccaccctgttcgagagcgatcacagccgagaagccgtttccgccagtgaaggtgtacgagatcttgccggtgcggtaggagccagccgagatcacgtcatcgttgatgacatcgccgaggtaaccggtgaaggtatggaattccgattcatcgataccaacgcgcagaccaccgagctggatatacgcgaactccatgacggtgccgctgctggtttcattaccatatttaccatctacgcccgaattgttcgcagcatagttgaagcgcagttcggtgaaggtcttgagggtgccgagttcggtttccgaaccggtggaaacgcggagtgcgaaacgagcgctcttgtcccagccattgcggtcggtaccggagtaaacgtcatcgccgccctttacgtcgtaacggacgtaaccatggacgcgcaggcaggtttcggtgcccggaatgtagaagtagccagcgccgtaagcgtcgcaaacgcggacatattcaacggcttcgggctctggcgcgacgattgcgtcggcagcctgagcgccggaagctgcaaccagagctgcagcggagccaaggagaaggctcttgatgttcatttctgacctccagtcaaagttaaaaatgggtctgggcattctgatttggctgaaggacaacctgtccccatcccctaattgaaaaagtcgccccgaagcgctccttcttctgaaagtgaagatactcgcccatttattcgtttcaacatcgaatatgttctcacaacctttatggtgctgctatgaagggcagttgttgcagaaatgacacgaaattacctgctttagctcggcggattcatgctttattaacataagtgaacgcgaattaaccgatgttaacgtttgaaaatgcaagttttttaggatcgcctgcagaataaagccgcgaatctttcgtcgaaacagcccttaacggaatatgtcggcaaggtggcaagaatcgtctgaacggagagcag

SEQ ID NO: 325 - DNA, 1434 bp, Brucella canis, U26439
tgttcttccactcgccaccaaacttggtgtaggaaacttccggcgtaacggtgaagccaggaaccagttcgtaagcaacgttagccgtaactgccgtcttgccccagtcgtcatgcgcagcctgcaggttgaaggcagccttctgcgtagcctgatacttcagaccaccccagacagcccaatcgccgccccactggccgtagttctgatccggcgtagcagcggacgaatatgcgccctgcaaccaaaccgagaactggtcggtgatgttgacgtcgccacgaaccttggcagcccattcttcgatgaccgagtcataggcaacaacaccagcgatcgaaccccagccgccagcatacttcaggccgccaacaacgtcaggcatgtagccgtcgatgtggtagttggtcgtgccagtgtaaccaccgtcgttgtcgccaccctgttcgagagcgatcacagccgagaagccgtttccgccagtgaaggtgtacgagatcttgccggtgcggtaggagccagccgagatcacgtcatcgttgatgacatcgccgaggtaaccggtgaaggtatggaattccgattcatcgataccaacgcgcagaccaccgagctggatatacgcgaactccatgacggtgccgctgctggtttcattaccatatttaccatctacgcccgaattgttcgcagcatagttgaagcgcagttcggtgaaggtcttgagggtgccgagttcggtttccgaaccggtggaaacgcggagtgcgaaacgagcgctcttgtcccagcctttacgatccgagccggtataaacgtcgtcgccgccctttacgtcgtaacggacgtaaccatggacgcgcaggcaggtttcggtgcccggaatgtagaagtagccagcgccgtaagcgtcgcaaacgcggacatattcaacggcttcgggctctggcgcgacgattgcgtcggcagcctgagcgccggaagctgcaaccagagctgcagcggagccaaggagaaggctcttgatgttcatttctgacctccagtcaaagttaaaaatgggtctgggcattctgatttggctgaaggacaacctgtccccatcccctaattgaaaaagtcgccccgaagcgctccttcttctgaaagtgaagatactcgcccatttattcgtttcaacatcgaatatgttctcacaacctttacggtgctgctatgaagggcagttgttgctgaaatgacacaaaattacctgctttagctcggcggattcatgctttattaacataagtaaacgcgaattaaccgatgttaacgtttgaaaatgcaagttttttaggatcgcctaccgaataaagccgcgaatctttcgtcgaaacagcccttaacggaatatgtcggcaaggtggcaagaatcgtctgaacggagagcag

SEQ ID NO: 326 - DNA, 1434 bp, Brucella melitensis (F6145), U26440
tgttcttccactcgccaccaaacttggtgtaggaaacttccggcgtaacggtgaagccaggaaccagttcgtaagcaacgttagccgtaactgccgtcttgccccagtcgtcatgcgcagcctgcaggttgaaggcagccttctgcgtagcctgatacttcagaccaccccagacagcccaatcgccgccccactggccgtagttctgatccggcgtagcagcggacgaatatgcgccctgcaaccaaaccgagaactggtcggtgatgttgacgtcgccacgaaccttggcagcccattcttcgatgaccgagtcataggcaacaacaccagcgatcgaaccccagccgccagcatacttcaggccgccaacaacgtcaggcatgtagccgtcgatgtggtagttggtcgtgccagtgtaaccaccgtcgttgtcgccaccctgttcgagagcgatcacagccgagaagccgtttccgccagtgaaggtgtacgagatcttgccggtgcggtaggagccagccgagatcacgtcatcgttgatgacatcgccgaggtaaccggtgaaggtatggaattccgattcatcgataccaacgcgcagaccaccgagctggatatacgcgaactccatgacggtgccgctgctggtttcattaccatatttaccatctacgcccgaattgttcgcagcatagttgaagcgcagttcggtgaaggtcttgagggtgccgagttcggtttccgaaccggtggaaacgcggagtgcgaaacgagcgcccttgtcccagccattgcggtcggtaccggagtaaacgtcatcgccgccctttacgtcgtaacggacgtaaccatggacgcgcaggcaggtttcggtgcccggaatgtagaagtagccagcgccgtaagcgtcgcaaacgcggacatattcaacggcttcgggctctggcgcgacgattgcgtcggcagcctgagcgccggaagctgcaaccagagctgcagcggagccaaggagaaggctcttgatgttcatttctgacctccagtcaaagttaaaaatgggtctgggcattctgatttggctgaaggacaacctgtccccatcccctaattgaaaaagtcgccccgaagcgctccttcttctgaaagtgaagatactcgcccatttattcgtttcaacatcgaatatgttctcacaacctttacggtgctgctatgaagggcagttattgcagaaatgacacgaaattacctgctttagctcggcggattcatgctttattaacataagtgaacgcgaattaaccgatgttaacgtttgaaaatgcaagttttttaggatcgcctgccgaataaagccgcggatctttcgtcgaaacagcccttaacggaatatgtcggcaaggtggcaagaatcgtctgaacggagagcag

SEQ ID NO: 327 - DNA, 1434 bp, Brucella neotoma, U26441
tgttcttccactcgccaccaaacttggtgtaggaaacttccggagcaacggtgaagccaggaaccagttcgtaagcaacgttagccgtaactgccgtcttgccccagtcgtcatgcgcagcctgcagattgaaggttgccttttcggtggcaatgaactttgcaccaccccagacagcccaatcgccgccccactgaccgtagttctggttcggcgtcgctgcggacgaatatgcgccctgcaaccaaaccgagaactggtcggtgatgttgacgtcgccacgaaccttggcagcccattcttcgatgaccgagtcataggcaacaacaccagcgatcgaaccccagccgccagcatacttcaggccgccaacaacgtcaggcatgtagccgtcgatgtggtagttggtcgtgccagtgtaaccaccgtcgttgtcgccaccctgttcgagagcgatcacagccgagaagccgtttccgccagtgaaggtgtacgagatcttgccggtgcggtaggagccagccgagatcacgtcatcgttgatgacatcgccgaggtaaccggtgaaggtatggaattccgattcatcgataccaacgcgcagaccaccgagctggatatacgcgaactccatgacggtgccgctgctggtttcattaccatatttaccatctacgcccgaattgttcgcagcatagttgaagcgcagttcggtgaaggtcttgagggtgccgagttcggtttccgaaccggtggaaacgcggagtgcgaaacgagcgctcttgtcccagccattgcggtcggtaccggagtaaacgtcatcgccgccctttacgtcgtaacggacgtaaccatggacgcgcaggcaggtttcggtgcccggaatgtagaagtagccagcgccgtaagcgtcgcaaacgcggacatattcaacggcttcgggctctggcgcgacgattgcgtcggcagcctgagcgccggaagctgcaaccagagctgcagcggagccaaggagaaggctcttgatgttcatttctgacctccagtcaaagttaaaaatgggtctaggcattctgatttggctgaaggacaacctgtccccatcccctaattgaaaaagtcgccccgaagcgctccttcttctgaaagtgaagatactcgcccatttattcgtttcaacatcgaatatgttctcacaacctttacggtgctgctatgaagggcagttgttgcagaaatgacacgaaattacctgctttagctcggcggattcatgctttattaacataagtgaacgcgaattaaccgatgttaacgtttgaaaatgcaagttttttaggatcgcctgccgaataaagccgcaaatctttcgtcgaaacagcccttaacggaatatgtcggcaaggtggcaagaatcgtctgaacggagagcag

SEQ ID NO: 328 - DNA, 1449 bp, Brucella ovis, U26442
tgttcttccactcgccaccaaacttggtgtaggaaacttccggcgtaacggtgaagccaggaaccagttcgtaagcaacgttagccgtaactgccgtcttgccccagtcgtcatgcgcagcctgcaggttgaaggcagccttctgcgtagcctgatacttcagaccaccccagacagcccaatcgccgccccactgaccgtagttctggttcggcgtcgctgcggacgaatatgcgccctgcagccataccgagaaccggtcggtgatgttgacgtcgccacgaacctttgtagcccattcttcgatgaccgagtcataggcaacaacaccagcgatcgaaccccagccgccagcatatttcaggccgccaacaacgtgcggcatgtaaccgtcgatcgtgtaatcgttgtcaacgtcttcgccaccctgttcgagagcgatcacagccgagaagccgtttccgccggtgaaggtgtaggcgatcttgccggtgcggtaggagccagccgagatcacgtcatcgttgatgatatcaccgaggtaaccggtgaaggtatggaattcggattcgtcgataccaaccttgaaaccaccaagcgtgatatatgcaaactgcagatcggtgccggtgcttacgctgccatcagcgacatcacgatcatcgctgaaatcgccgtattggccatcatgacgtgaattgttgctggtgtagttgaagcgcagcgtagtataggtgccgagtgtgccgagttcggtttccgaattcgtgttgaacatggagtgcaaaacgagcaccttgtcccagcctttacgatccgagccggtataaacgtcgtcgccgccctttacgtcgtaacggacgtagccgctgatgcgcaggcaggtttcggtgcccggaatgtagaagtagccagcgccataagcgtcgcaaacgcggacatattcaacggcttcgggctctggcgcgacgattgcgtcggcagcttgagcgccggaagctgcaaccagagctgcagcggagccaaggagaaggctcttgatgttcatttctgacctccagtcaaagttaaaaatgggtctgggcattctgatttggctgaaggacaacctgtccccatcccctaattgaaaaagtcgccccgaagcgctccttcttctgaaagtgaagatactcgcccatttattcgtttcaacatcgaatatgttctcacaacctttacggtgctgctatgaagggcagttattgcagaaatgacacgaaattacctgctttagctcggcggattcatgctttattaacataagtgaacgcgaattaaccgatgttaacgtttgaaaatgcaagttttttaggatcgcctgccgaataaagccgcgaatctttcgtcgaaacagcccttaacggaatatgtcggcaaggtggcaagaatcgtctgaacggagagcag

SEQ ID NO: 329 - DNA, 1434 bp, Brucella suis (A44), U26443
tgttcttccactcgccaccaaacttggtgtaggaaacttccggcgtaacggtgaagccaggaaccagttcgtaagcaacgttagccgtaactgccgtcttgccccagtcgtcatgcgcagcctgcaggttgaaggcagccttctgcgtagcctgatacttcagaccaccccagacagcccaatcgccgccccactggccgtagttctgatccggcgtagcagcggacgaatatgcgccctgcaaccaaaccgagaactggtcggtgatgttgacgtcgccacgaaccttggcagcccattcttcgatgaccgagtcataggcaacaacaccagcgatcgaaccccagccgccagcatacttcaggccgccaacaacgtcaggcatgtagccgtcgatgcggtagttggtcgtgccagtgtaaccaccgtcgttgtcgccaccctgttcgagagcgatcacagccgagaagccgtttccgccagtgaaggtgtacgagatcttgccggtgcggtaggagccagccgagatcacgtcatcgttgatgacatcgccgaggtaaccggtgaaggtatggaattccgattcatcgataccaacgcgcagaccaccgagctggatatacgcgaactccatgacggtgccgctgctggtttcattaccatatttaccatctacgcccgaattgttcgcagcatagttgaagcgcagttcggtgaaggtcttgagggtgccgagttcggtttccgaaccggtggaaacgcggagtgcgaaacgagcgctcttgtcccagccattgcggtcggtaccggagtaaacgtcatcgccgccctttacgtcgtaacggacgtaaccatggacgcgcaggcaggtttcggtgcccggaatgtagaagtagccagcgccgtaagcgtcgcaaacgcggacatattcaacggcttcgggctctggcgcgacgattgcgtcggcagcctgagcgccggaagctgcaaccagagctgcagcggagccaaggagaaggctcttgatgttcatttctgacctccagtcaaagttaaaaatgggtctgggcattctgatttggctgaaggacaacctgtccccatcccctaattgaaaaagtcgccccgaagcgctccttcttctgaaagtgaagatactcgcccatttattcgtttcaacatcgaatatgttctcacaacctttacggtgctgctatgaagggcagttgttgctgaaatgacacgaaattacctgctttagctcggcggattcatgctttattaacataagtgaacgcgaattaaccgatgttaacgtttgaaaatgcaagttttttaggatcgcctaccgaataaagccgcgaatctttcgtcgaaacagcccttaacggaatatgtcggcaaggtggcaagaatcgtctgaacggagagcag

SEQ ID NO: 330 - DNA, 1117 bp, Burkholderia mallei (Glanders), AY032868
gagagctgatacgctagcgggccgcgatgccgggtgcgcgcacgccgcgtgcccgattcgcgcccgttcaatcttcccgcgatccgcctgatgaatcattctccgttgcgccgctcgctgctcgtcgcagccatttccaccccactgatcggcgcctgcgcgccgctgcgcggccaagcgaaaaacgtcgccgccgccgagcggcaattgcgcgaactcgaatcgacgttcgacggccgcttgggcttcgtcgcgctcgacaccgcgaccggcgcgcgcatcgcgcatcgcggcgacgagcgtttcccgttctgcagcacatccaagatgatgctttgcgctgcggtcctcgcgcgcagcgccggcgagcctgcgctgctgcagcggcggattgcgtacgcgaagggcgatctcatccgctattcgccgatcaccgagcagcacgtgggcgccggcatgagcgtggctgagctgtgcgcggcgacgcttcagtacagcgacaacaccgcggcgaacctgctgatcgcgctgctcggcgggccgcagaccgtcaccgcgtatgcgcgctcgatcggcgacgcgacgttccggctcgatcgccgcgagcctgagctgaacacggcgctgcccggcgacgagcgcgatacgacgacgcccgccgcgatggccgcgagcgtgcaccggctgctcgtgggcgacgcgctcggcgccgcgcagcgcgcgcagctcaatgcatggatgctcggcaacaagacgggcgacgcgcgcatccgcgcgggcgtgccggccgactggcgcgtcgccgacaagacgggcacgggcgactacggaacggcgaacgacatcggcgtggcgtatccgccgaatcgcgcgccgatcgtgttcatcgtctatacgacgatgcgcaatccgaacgcacaggcgcgcgacgacgtgatcgcgtcggcgacgcggatcgccgcgcgggcgttcgcctgagcgcgcgcggccgcgcgccgttcgggcggggccggccgaaaccggccggcgctcgcgtgacgcgcgccgcggcgcgcgccggccgtttcgcgaggcgacctgcgcgccggccggcgcgcggcggcttccggaaggttca

SEQ ID NO: 331 - DNA, 1015 bp, Burkholderia mallei (Glanders), AY124769
cgttggttatcgcaccgaactggatcggtgacgcattgatggcgcagccgcttttcgcgctgctgaagaaactgcatccccgcatcgtcatcgatgccgtggcgcccgcgtgggtcgcgcccgtgctcgagcggatgcccgaaatccacgatgtccacgcgaccgagctcgcgcacggcaagctgcagatgctgcaccgctggcagctcgcgagcgacttgcgcgagctcggttacgacgccgcgtacgtgctgccgaactcgctgaaatcggcgctgattccgtggttcgccggcatcccgcttcggatcggctacacgggcgagcatcgctacgcgctcctgaacgtgcggcatgcgaatccgggcaaggcgcgcgagacgcgcgcgccgatggcacaacattacgcggcgcttgcatacgcgcccggcgcgaagctgccgaatcgttccagacgcttgccgccgccgcggctcgaagcggacctgaacgagacggcgcgcgtgtcggcgcgctttaacctcgacacgcgcaagccgctcatcgtgttctgtccgggcgccgagtacggcccggccaagcgctggccccccgagcatttcgccgcgctcgcgcagagcgtgagccagtcctttccgtacacgcagatcgtcgcgctcggctcgccgaaggacgccgcagccgcgcaggcgatcgccgagcgcgcgccgaacgtgcgcagcctctgcggccagacctcgctcaccgaggcgtgcgtgctgatcgcgcgcgcgaacgcggtcgtcacgaacgattccgggctgatgcacgtcgcggcggcgctgcgccggccgctcgtcgcgctctacggatcgaccgatccgcgtcataccccgccgctgtcggagctggcaaaggtacaatggctgcatctcgaatgcagtccctgcttcgaacgcgaatgcccgctcggccacctgaagtgcctgcgcgagctgagcccggagcaggtgttcggcgatttgcgcgggatgct

SEQ ID NO: 332 - DNA, 1117 bp, Burkholderia pseudomallei (Meliodosis), AY032869
gagagctgatacgctagcgggccgcgatgtcgggtgcgcgcacgccgcgtgcccgattcgcgcccgttcaatcttcccgcgatccgcctgatgaatcattctccgttgcgccgctcgctgctcgtcgcagccatttccaccccactgatcggcgcctgcgcgccgctgcgcggccaagcgaaaaacgtcgccgccgccgagcggcaattgcgcgaactcgaatcgacgttcgacggccgcttgggcttcgtcgcgctcgacaccgcgaccggcgcgcgcatcgcgcatcgcggcgacgagcgtttcccgttctgcagcacatccaagatgatgctttgcgctgcggtcctcgcgcgcagcgccggcgagcctgcgctgctgcagcggcggattgcgtacgcgaagggcgatctcatccgctattcgccgatcaccgagcagcacgtgggcgccggcatgagcgtggccgagctgtgcgcggcgacgcttcagtacagcgacaacaccgcggcgaacctgctgatcgcgctgctcggcgggccgcagaccgtcaccgcgtatgcgcgctcgatcggcgacgcgacgttccggctcgatcgccgcgagcctgagctgaacacggcgctgcccggcgacgagcgcgatacgacgacgcccgccgcgatggccgcgagcgtgcaccggctgctcgtgggcgacgcgctcggcgccgcgcagcgcgcgcagctcaatgcatggatgctcggcaacaagacgggcgacgcgcgcatccgcgcgggcgtgccggccgactggcgcgtcgccgacaagacgggcacgggcgactacggaacggcgaacgacatcggcgtggcgtatccgccgaatcgcgcgccgatcgtgttcatcgtctatacgacgatgcgcaatccgaacgcacaggcgcgcgacgacgtgatcgcgtcggcgacgcggatcgccgcgcgggcgttcgcctgagcgcgcgcggccgcgcgccgttcgggcggggccggccgaaaccggccggcgctcgcgtgacgcgcgccgcggcgcgcgccggccgtttcgcgaggcgacctgcgcgccggccggcgcgcggcggcttccggaaggttca

SEQ ID NO: 333 - DNA, 1100 bp, Burkholderia pseudomallei (Meliodosis), AF097748
agcgcggcgcacgagcgtcgcgtttattacgaacatcggaaaacgacctgatgcgtcgcgcgttggttatcgcaccgaactggatcggtgacgcattgatggcgcagccgcttttcgcgctgctgaagaaactgcatccccgcatcgtcatcgatgccgtggcgcccgcgtgggtcgcgcccgtgctcgagcggatgcccgaaatccacgatgtccacgcgaccgagctcgcgcacggcaagctgcagatgctgcaccgctggcagctcgcgagcgacttgcgcgagctcggttacgacgccgcgtatgtgctgccgaattcgctgaaatcggcgctgattccgtggttcgccggcatcccgcttcggatcggctacacgggcgagcatcgctacgcgctcctgaacgtgcggcatgcgaatccgggcaaggcgcgcgagacgcgcgcgccgatggcacaacattacgcggcgcttgcatacgcgcccggcgcgaagctgcccgaatcgttccagacgctgccgccgccgcggctcgaagcggacctgaacgagacggcgcgcgtgtcggcgcgctttaacctcgacacgcgcaagccgctcatcgtgttctgtccgggcgccgagtacggcccggccaagcgctggccccccgagcatttcgccgcgctcgcgcagagcgtgagccagtcctttccgtacacgcagatcgtcgcgctcggctcgccgaaggacgccgcggccgcgcaggcgatcgccgagcgcgcgccgaacgtgcgcagcctctgcggccagacctcgctcaccgaggcgtgcgcgctgatcgcgcgcgcgaacgcggtcgtcacgaacgattccgggctgatgcacgtcgcggcggcgctgcgccggccgctcgtcgcgctctacggatcgaccgatccgcgtcataccccgccgctgtcggagctggcaaaggtacaatggctgcatctcgaatgcagtccctgcttcgaacgcgaatgcccgctcggccacctgaagtgcctgcgcgagctgagcccggagcaggtgttcggcgatttgcgcgggatgctcgtcggacagcgctgatgtccgcgg

SEQ ID NO: 334 - DNA, 611 bp, Burkholderia cepacia, U70431
catggaagaaagcaagaagggctccgggatgaccgccgagaagagcaaggcgctggctgccgcactcgcgcagatcgagaagcagttcggcaaagggtcgatcatgcgcatgggcgacggcgaggcggccgaggacatccaggtcgtgtccacgggctcgctcgggctcgacatcgcactgggcgtcggcggcctgccgcgcggccgcgtggtcgagatctacgggccggaatcgtccggcaagaccacgctcacgctgcaggtcattgccgagctgcagaagctgggcggcaccgcggcgttcatcgacgccgagcacgcgctcgacgtccagtacgcggcgaagctcggcgtcaacgtgccggatctgctgatctcgcagccggacaccggcgagcaggcgctcgaaatcaccgacgcgctggtgcgctcgggctcgatcgacatgatcgtcatcgactcggtcgcggcgctcgtgccgaaggccgaaatcgaaggcgagatgggcgattcgctgccgggcctgcaggcgcgcctgatgtcgcaggcgctgcgcaagctgacgggcacgatcaagcgcacgaactgcctcgtgatcttcatcaaccaga

SEQ ID NO: 335 - DNA, 810 bp, Clostridium perfringens, 18143657:7100-9391
gaagacttaatacaagaagaggatgttgtaataactcttactcacactggatatattaagagaatatcttcagatgtttactcagctcaaaagagaggtggtaagggaatacaagcaatgacaacaaaagaagatgactttgttgaaaatgtacttgtaacatcaacacactcaaacttattattctttacaactaagggtaaggtttataagataaaagcttatgaggtaccagatgcaggaagaactgctaagggaacaaatcttgtaaatatattaccattagaagcagatgaaaaaatacaaactgttctttcatttaaggatgttcaagaagatggatacttatttatgggaactaaactaggaatagttaagaaaacaccattaaaagacttcaagaatataagaaagaatggattaatagcattaaaccttagagaaggtgacgagcttctaagagctaaaataacatatggagacgcagatattatatttgtaactcaagacggtaatgctataagatttaatgaaacagatgttagacctatgggtagaactgcatctggagttaaagctataagcttaagagaaggcgacgttgctgtttgtatggatatagctgtagaagacgaaaaattactagttgtcagtgaaaatggttatggtaagagaactaacctagatgaatataaagttcaaaatagaggtggaataggtcttataacatataaagtatctgataagactggtaaagtagttggtgctactgtatgtaaagaagatgatgagcttatgcattataaatag

SEQ ID NO: 336 - DNA, 1113 bp, Clostridium perfringens, 18146729:c45993-44881
atgaaaaagaaatttctttctgctgtgttagcagtacttacaacagctactttacttgcagggtgtggaggttcaagtgatggacaagcatcatcaggtgatactggttctaagggagacaaaatgaaggttggaatggttactgatgccggtacaatagatgataagtcatttaaccaaggaacttgggaaggaatacaaaaagctgaaaaagacttaggagtagaagctaagtatttaaaaccaagtggaacaacagaagctgattacttaaaagaaataggaaatctttacgatgcaggattcaaatttatagtaactccaggatttaaatttgagacagctatatataaaggacaagaaaaatataaagatgctaaatttgtattattagatggtgctcctcattcaggtgctaaggatgcaaagccagaagtaggtccgaatacggtttcaatattctttgctgaagagcaagcaggttttatggcaggtgttgctacagcattacaacttaaagaaggtcaattaggatttataggtggtatggaaattccaccagtacaaaaatttaactggggattccaacaaggggtagcctttgctaatgaaaaattaggaactcacatgtctcttgaagcaaaaaatgttatatatcaaggatcatttgatgactcagctgcaggtggacaaatagctgctcaaatgtatgacaatggagtaaaagctatattctgtgctgctggtggtgttggtgtaggcgctatacaagaagctaaaaatagagctgcttcaggaaaagaagcttggataataggtgttgacgttgaccaatacgacgatggtatatatgaaggagataaatctgtaatacttacttcagcagttaagagaatagatcacgcttcttatgacatgataaagaaagaattagatggaactttcccaggtggacaaactttattatatgatgcaaaaaatgatggtgtaggtttacctgataagaatccaaacttaagtgaagaaactatgactgaagtaaataaagtatttgaacagttaaaaaatggagaaataaaagtttctaacgagcaaggagacttaataaattaa

SEQ ID NO: 337 - DNA, 812 bp, Coxiella burnetii, 29540947:165494-168040
gaagatttaattcctgaagaacatagggttgtaaccttatcccatgaaggttatatcaaatcgcaatcgttgagcagttatcaagcgcaacatcgcggtgggcgcggtaaattggctgctgccgtaaaagaacaggattttgtaaaaaatattttagtggccaatagccacgatacaattttatgcttttcgactcagggaaaagtttattggcttaaggtttatcaagtgccgcaaggtagccgtatagcgcgcggacgaccgataattaatttattacccctcgttaaagacgaacaaatttctgctattttgccgatacgcgcctatgatggatcgcatttcgtttttatggccaccgcgcaaggcgctataaaaaaagtatctttggctgaattttcacaaccgcgtacaaagggtaaaattgccttggcgttgaacgaaggcgatcgtttagtgggtgttgacattaccgatggaaaaaaagaaattatgttggtgaccgatgccggaaaagccattcgttttcacgaaaaggaagttcgcgaaatgggtcgttcagcgcgaggcgttcgtggcattaaactaaaagccaaacaaaatgtgattgcgttaattgttgtaaaacccaaagggaatatattgacggccaccgtgcacggttacgggcagcgtaccgcattggatgattatcgctccaccggtcgaggcgggcagggtgtgatggcgatacggattaattcccgcaatggaaaggtggtttccgctgcgcaggtgtttgatgacgacgatgtattgctcattagtgataa

SEQ ID NO: 338 - DNA, 745 bp, Coxiella burnetii, 29540626:51830-53680
atttagacaaccagcttgaaaacctacgggcgattacgggtcaggaataccgctcgttgactagcctgaaaaaatccattccgctagtgataccccatcctcgaaacatcgatgcctggacggcggttgcagagcgacaaagtttcgctattcagtccgcattatataccatgctggctcagcgcgagacggttaaagaaacggcggcccaacgctatcccacgctaacagggactttttcctatggcgctcaacaacgagggtttccccccagcctctccggcccgcctacgacgggggaatttttagatacgactaccacaacagccacggctggtcttaatttgaatttccccgttttccaaggcggttttgtgacccattctacccggcaggaagaatataattatttgtcggccagcgaccaacttaatttcactcatcgcgatgtggtacgacaaacgcgtcaagcttatttaggggttgattcgggaattagtaaaatcagagcggaccgtcaagccatcatttctgcgcaaaacaaactggaagcgacacaggcggggtacgtagtgggaacccgaaccatggtagacgtattggatgcggtgacctctttgtaccaagctcagcaacaatgggcaacggatcgatacagttacatcatcaacatcattactttaaaacaacaagcgggaaccttatgcccccatgatttagcgcaaataaatacctggctaggaaa

SEQ ID NO: 339 - DNA, 531 bp, Francisella tularensis subsp. tularensis strain, 32469331:c985-455
atgaaaaaaataattatatgggttttagagcaaataatagctttgttagataaaggcaaaaataagtcaaatgaatataattatgacaattctaataaaggaattcaagttgttgaaagtatgcctattgataatagtgtgacaaacaatatctcgtatggcacgcctgaattagaacctaattgccagataatagaagaaaaaattttaggttcagtctttaattggatatataagccgtatatcatgatgggaactataatttatattttaattttagttgctgaaattgttctgtatccacggtttgaaataacaattgaaaatacttggagcattattttctttacaccacttgttataacaatgatgtttttattatttttattatcgtatgaagagtatagattttctgttttgagtgagataagaaaaaatggctggagtgaagatactagaaatcaatttgtttacaaaaaaattaatgatgagattattagatatcgatacaaaatatactctccaatttag

SEQ ID NO: 340 - DNA, 285 bp, Francisella tularensis subsp. tularensis strain, 32469331:c1338-1054
atggcttttgtgtatattttggcgagtaagagaaatggtactctatatattggagtaacagcaaatcttattaaaagagtttatgagcatagacaaggttttgctgatggatttactaaaaagtatgatataaaaattttagtttattatgagcaatttaaaaatatacaagatgctatttacagagaaaaaagacttaaaacttggcaaagacagtggaagatagatctgataaatgagtttaatcctgattggttagacttgtatgagaacattctagactag

SEQ ID NO: 341 - DNA, 834 bp, Francisella tularensis, M32059
ggcgagtgatactgcttgtaagacatataatttgcttgttaatgaaaatcgtaatgttagctgtatcatcatttaataaactgctgtttattttattttaattaatgttataatcgatttgagtatatgtgaatatttaaaaataggagtatctatatgaaaaaaataattaagcttagtcttttatctttatcaatcgcaggtttagcgagctgttctactctagggttaggtggctctgatgatgcaaaagcttcagctaaagatactgctgctgctcagacagctactactgagcaagctgctgctgtatctaagccaactgcaaaagtaagtttaaataaacttggtcaggataaaataaaagcaactgtatatacagcatacaataataacccacaaggaagtgtaagattacaatggcaggctccagaaggttctaagtgccatgatacaagcttcccaattactaagtatgctgagaagaacgataaaacttgggcaactgtaacagttaagcaaggtaataacttctgtagcggtaagtggacagctaatgtagtttatgacaaagaagtaatcgcttctgattcaataaatatttaatttcttcaaatatttataattttctagtttttgcttttctcaaaaaaaaataacggtgtgattaattttgcttagctagattagttgtacttttaactttttactaaaaagatttgctataattgcttaaatataacaaataaaaaagtaatagtttaatgaaaaacattatcttgttattaatgatattctcgatgttagttgtacttagccatgtgcaccaaccac

SEQ ID NO: 342 - DNA, 960 bp, Francisella tularensis, AF513319
atggctagaaaaaaaataacacttgttggtgctggtaatattggtggtacactagctcacttagcacttataaaacaattaggtgatgtagtcctttttgatatagctcagggcatgcctaatggcaaagcacttgatttactacaaacttgccctatcgagggagttgattttaaagtcaggggtacaaatgattacaaagatttagaaaattctgatgttgttattgtaactgctggtgttccgagaaagcctggcatgtctcgtgatgacctacttggtattaatatcaaagtaatgcaaacagtcggagaaggtatcaaacataactgtcctaatgctttcgtaatatgtatcacaaatccactagatattatggtaaatatgttacaaaaattctcaggcgtaccagataacaaaatcgttggtatggctggtgttttagattctgctagatttagaacatttttagcagatgaactaaatgtatcagtacaacaagtacaagcatatgtaatgggcggtcatggcgatactatggtccctctaactaaaatgtcaaatgttgcaggtgtgtcgttagagcagctagttaaagaaggtaaacttaaacaagagcgtttagatgctatagtatcgagaactagaagtggtggtggcgaaattgttgctttacttaaaacaggttcagcatattatgcaccagctgctgcaggtattcaaatggctgaaagcttcttaaaagataaaaagatgattttaccttgtgctgcaaaagtaaaagctggtatgtatggccttgatgaagatctatttgttggtgtaccaactgagatttctgcaaatggtgtcagacctattgaagtagagatttctgataaagaaagagaacaattacaagtatctataaacgctgtaaaagatcttaataaagcagctgctgaaattttagcaaaataa

SEQ ID NO: 343 - DNA, 431 bp, Francisella tularensis; identical to SEQ ID NO: 52

SEQ ID NO: 344 - DNA, 111 bp, Francisella tularensis; identical to SEQ ID NO: 53

SEQ ID NO: 345 - DNA, 546 bp, Orientia tsutsugamushi, AY191589
gttgaagttgttaaaggaatgagatttgaccgtggatatatatcacagtactttgcaacgaatcgtgaaaagatgattaccgaatttgaaaatccttatattttgctgttggatcagaaggtatctacagtacagccacttgtccctgttcttgaggcagttgctcatactggcaaaccattagaattaattgctgatgatgtagacggagaagctcttaccgcattgatattaaacaatttaaaaggttccattaaagtagtggcagttaaagcgccaggttttggtgatcgtaaaaaagaaatgttggaagatattgctattttaacaaatggagaagtaattactgaacaactaggaatcaaactagaaaaggttaatgatacatctaagttaggaactgcaaatagagttattgttacaaaagatcatactactatagttcatgataagaataatagtgatatagagaagaaagttaattctcgttgtgaacagattcgtgaagcaattaaagatacaacttcagattatgataaagaaaaa

SEQ ID NO: 346 - DNA, 1059 bp, Orientia tsutsugamushi, AY283180
ctagtgcaatgtctgcgttgtcgttgccattttcagctagtgcaatagaattgggggaagaaggattagagtgtggtccttatgctaaagttggagttgttggaggaatgattactggcgtagaatctgctcgcttggatccagctgatgctgaaggcaaaaaacacttgtcattaacaaatgggctgccatttggtggaacgttggctgcaggtatgacaatcgctccaggatttagagcagagataggtgttatgtaccttacaaatataactgctcaggttgaagaaggtaaagttaaggcagattctgtaggtgagacaaaggcagattctgtaggtgggaaagatgctcctatacgtaagcagtttaaacttacacctcctcagcctactataatgcctataagtatagctgatcgtgactttgggattgatattcctaacatacctcagcagcaagcacaagcggcgcagccccagcttaatgatgagcaacgtgctgcagctaggatcgcttggttaaagaattgtgctggtattgactatagggtaaaaaaccctaatgatcctaatgggcctatggttataaatccgatattgttaaatattccacagggtaaccctaatcctgttggaaatccaccgcagcgagcaaatccgcctgcaggttttgcgatacataaccatgagcaatggaggcatttggtagttgggcttgctgcattatcaaatgctaataaacctagcgcttctcctgtcaaagtattaagtgataaaattactcagatatatagtgatataaagccatttgctgatatagctggtattgatgttcctgatactagtttgcctaatagtgcatctgtcgaacagatacagaataaaatgcaagaattaaacgatctattggaagagctcagagaatcttttgatgggtatcttggtggtaatgcttttgctaatcagatacagttgaattttgtcatgccgcagcaagcacagcagcaggggcaagggcagcaacagcaagctcaagctacagcgcaagaagcagtag

SEQ ID NO: 347 - DNA, 968 bp, Rickettsia prowazekii, 3860572:250672-253389
gaagatttaattcagcgtgaagaaatggtcgtaaccgtaacgcttggtggttatatcaaacgtgtacctctaagtagctatcgttcgcaaaaacgtggaggtaaggggagatctggtctttcaatgcgagatgaggatattaccacgcaagtttttgttggtagtacacatacaccaatgttatttttctcaaatataggtaaggtttatagcttgaagctttataaattgcctttaagtaatccgcaaggtaagggtagaccaatggttaatatattatcattgcaagaaaatgagcatattacaaatattatgccgttaccagaaaaccaggatgagtgggatcatttaaacattatgtttgcaactgcaaaaggtaatatcagaagaagtgatttattagattttaaaaagattcagtcaaatggtaaaattgctattagacttgatgaagacgataaattaatagacgtaaaaccatgtaaagaagatgagcatattttacttgctaccaaagcaggtaaagctttaagatttcctgttgaatctttgcgtattattaagagtcgtatttctgatggggtgcgaggtatgaagcttgctaaagaggattctgtaatttctatgactgtacttaaaggcattaacagcacaaaagaggatagagatgcttatttaacagtgccatgggaaaaaagacttgagatagctaaaggtgaggagtttaaccttgaagaattaggtgtaaatttgaatgcagattcgattttagaaatggcaaattcagaagaattcatcttgacggttacagagaacggttttggtaaaagaagctcggcatatggttatagaattactgatcgtggtggtagtggtataataaatatggatattaacgataaaaccggtttagtcgttggtgttatgccagttaaaatggatgatgagttaatgctaatcacaaatag

SEQ ID NO: 348 - DNA, 985 bp, Rickettsia prowazekii, 3860572:c191770-189464
tatataaacgtagcggacgtttttctactaaagtcacacctaaaatcaaaagtttagaaaacaacagagtgaaggttatttttgatatagctgaaggaccaaaaaccgttattaaatctatttattttagcggtaatgaacattacagcgattcagaactaaaatctattgtcttaactaaagaatctcgttggtttcgttttttagaaagtaatgatacttacgatcctgatagagtagaatatgataaagaattactaagagagttttatcaatctgtcggttttgcagattttagagtaatttcggcatcagtagcactcaatgatactaaagaatattttacaatcacctattccattgaagagggagaaaaatatagatttggtaatgttacaatagacaataaattaactaatataaatataaaacagcttaataaaattgttaatattaagcaaggcaaaatcttcaatatgaaaacagttgatgatatagctgaaaaaatcggagaatattttacagcgaatgggtatcctgcagtaaatgtttatccagatataaagaaaaatgataatcatactgcagatattaaatttattattgagaaggccgataaggtttatattaataaaataaatattattaataaccttaaaactgaagaccatgttataagaagagcatttaaaatagaagaaggtgatgtaatgaaccgttcatatattgaaaaaggtgagcgtaatcttagaaatttagattattttgaaaaagtatcaattagcttagctcagactaaggctaaagataaatatgatgttaatgttgaagttgatgaaaaatccacttcttctataggttttgatttaggatataatactgccggcggtttattcggacggttttcttttctagagcgtaatttagttggtaccggcaaactacttaacgctggtgtgcaggtaagtaaaaacagtacaagcta

SEQ ID NO: 349 - DNA, 812 bp, Yersinia pestis, 21959874:c10908-8233
gaagacctgattaatcaagaagatgtggttgtgacgttgtcccatcagggctacgtcaaataccagccgttgagtgattacgaagctcagcgtcgtggtggtaaaggtaaatctgctgcacgtatcaaagaagaagactttattgatcgcctgctcgttgccaatacccacgataccatcttgtgcttctccagccgtggccgtctctattggatgaaggtctatcaactgccggaagccagccgtggggctcgtggccgtcccatcgtcaacttgttgccgcttgagccaaatgagcgtattaccgccattctgcctgtgcgcgaatatgaagaaggctgtcatgtctttatggctaccgccagcggtactgtgaagaaaacggcattgacggagttcagtcgcccacgtagcgccggtattatcgccgttaatttgaacgaaggtgatgagcttatcggtgtggatctgacggatggcagcaatgaagttatgctgttctcagcattgggtaaagtggttcgtttcccagaagggcaggttcgctctatgggccgtaccgcaaccggtgtccgtgggatcaacctcaatggcgatgatcgggttatttctctgatcattcctcgtggtgatggtgaaatcctgaccgtaactgaaaacggttatggtaagcgtactgcagtggcagaatatccaaccaagtcccgtgcgactcagggggttatctccattaaagtcagtgagcgtaatggtaaggttgtcggtgctgttcaagttgcaccaactgaccaaatcatgatgatcactgatgc

SEQ ID NO: 350 - DNA, 913 bp, Yersinia pestis, 16120353:c1628253-1627192
gtggtaaattgggttggtctcagtatcaagatactggttctatcatcaataacgatggtccaactcataaagatcagctgggtgccggtgcgttcttcggttaccaagcaaatcagtacctgggctttgagatgggatacgactggcttggtcgtatgccttacaaaggcgacatcaataatggcgctttcaaggctcaaggcgttcagttagcagctaaactgagctacccagtagcacaagaccttgacgtatatacccgtctgggtggtttagtatggcgtgcagatgctaaaggctccttcgatggtggtcttgaccgtgctagcggccatgataccggtgtttctccattggtagctctgggtgctgaatacgcatggaccaaaaactgggcaacccgtatggaataccagtgggttaacaacatcggcgaccgtgaaaccgttggtgctcgtccagacaacggcctcctgagtgttggtgtttcttaccgctttggtcaggaagatgcagcagcgccaatcgttgctccaacacctgctccagcgccaattgttgacactaagcgtttcacattaaaatctgatgtgctgtttggtttcaacaaagcaaacctgaagccagaaggccagcaagctctggaccaactgtacgcacaactgagctctatcgatcctaaagatggttctgtagttgttctgggctttgctgaccgtatcggtcaaccagcgcctaacttagctctgtctcagcgtcgtgctgacagcgtgcgtgactacctggtttctaaaggtatccctgctgacaaaatcactgctcgcggtgaaggtcaagcaaacccagttacaggcaacacctgtgacaacgtgaaaccacgtgctgctctgattgagtgcctggcaccagatcg

SEQ ID NO: 351 - DNA, 517 bp, Yersinia pestis, AF350077
gtacagatgaattcttcactgataaaggggagtggataacgttgcagcagcttcgcgatattgacggccgggcattctctgatgcaggcctgtagaaaattacgctttaacaattaccgccaacggtaacaaactgagttatccaaaatctgagcctcgccatcgtgcggggttttttaatgggccaggcccagcaataaatcccaaggggacagcatgctattccgaaatatcgcacgtaaatattatgccgaggcaggtgaaggtggcgaaggtggaggcggggcagccgcagctatcacgccagagattcaggcattgattgatgcaagagttaatgaatctgttaccggccttaaaaccaaaaatagcgaattactcggcaagctcaaagagcaaggcgagaacctgaaacgctatgacggcatcgacccggacgcggtgaaaactatcctgcaacgattctctgacgacgaagaagccaagctgatcgccgctggaaagattgatgaggtac

SEQ ID NO: 352 - DNA, 525 bp, Yersinia pestis; identical to SEQ ID NO: 55

SEQ ID NO: 353 - DNA, 1082 bp, Ajellomyces capsulatus, U20346
ggttgcgccatgtggatataaacgggtatagttgccgttgctagatgtgctagtgctaatttggggtatcagatggatgcaagaaaactgcgtgggccaagtcgggtcaattcctcgcatgggcttgcattcgctctgcatgcaagatggccctcttggattcgatttggtgagcaacccagatgacgccttcatgcaaatatattttctaatgctagccagcccgattatgtttctgctttccccgccggggttaatgtcggcgcaacatttagtaaagagcttgcttatcttcgcggcaaagcaatgggcgaggagcaccgagataaaggtgtcgacgttgtattgggccctgtggttggaccgttgggcaggtcgccagatggagggcggaattgggaaggtttcagccctgatcctgtcaattccgggctccttgttgcggagaccatcaagggaattcaaagtgccggcgtcattgcttgtgtcaagcatttcataggcaacgagcaagaacgattccgccaaggccctgaggctcaagggtatggtttcgatatctcagagagttcaagttccaatattgacgacgtaaccatgcatgagctctatctctggtgggtgttgcttctgtgccttttatatacactagctgactgctattaggccatttgcggatgcagttcgagccggagttgggtccgttatgtgttcatacaatcaaattaataacagctacggctgcggaaacagttacacacagaacaaactactcaaggctgaacttggattccaggggtttataatgagcgactggcaggctcaccatagcggggttggctctgctctggctggcctagatatgtcaatgccaggcgatactgtgtttgggacaggtcgatcctactggggacccaacttgacaattgcagttgctaatggaactatcccggaatggcgagtggatgatatggccgttcgaattatggcggcttatttcaaagttggccgggaagcggctaaagtacccgtcaatttcaattcctggactcgagatgaatacggctatacgcatgctctcg

SEQ ID NO: 354 - DNA, 919 bp, Ajellomyces capsulatus, AF026268
ccgtctgtataccgatgaaggcaattttggtaagcattatatcgtggtagtcatactcataacagcacaacaaatatgaatacaaacccaggacctaggctgactactcggcaatgtagatatcgtcggaaacaacgttccagtcttcttcattcaggacgctattcaattccctgatttgattcacgctgtcaagccgcaaccagacagtgaaattccccaggctgcaactgcacatgatacggcatgggatttcctcagccagcagcccagctcattgcatgccctcttctgggcaatgtcaggacatggaatccctcgctcaatgcgtcatgttgatgggtggggcgtccataccttccgacttgtcaccgacgagggcaactcgaccttggtcaagtttcgctggaagaccctccaaggaagagcgggcctggtatgggaagaggcacaggctcttggcggaaagaatcccgacttccatcgacaagacctctgggatgccattgaatctggaaggtaccctgagtgggaggtaagatatgattcccccaaatcattagttctgacagtgtttctctgctctgtcggttgctcttttcgtctttttctatatcttcaactaagactgactttatatacgttttactcatatagctgggctttcaattggtgaatgaagcagatcaatccaagtttgatttcgatctattagatcccaccaaaatcatcccagaagaacttgttcctttcaccccaatcggaaaaatggtcttgaaccgaaacccaaaaagttattttgccgaaactgagcagatcatggttggtccaccccctatatatttggaatatgaatacatgtatagctagatgaagcgtatatctaaatatatttccacagttccaaccaggtcatgta

SEQ ID NO: 355 - DNA, 810 bp, Ajellomyces capsulatus, U27588
acacagcataacagaagatctctgaaattgacaaaaatgaaaaccatttgcttgcctgcttacttcaagcttctctcttttctgtctgctatagctgtgacatctggagcagctgttgactcctgtctcttagaatcaaactgcccaccgccaacaacaacaacgacaacaacgacaacaacaccaacaccaacaccaacatcaataataccaataacaccaatagtaccagcaaataagacaattgtgcttacaaccactattgagcctgggccaggccaggtttgggcgcaaatagaggagattgatcctgaaccatattatgttagatgggtccctgatccaacgtttgccacgcctgttgtactgcacaataacacagatcttgtcttcatggatggaagcaaatctttttatctcaacttcgataacagcacctctgacacgggtatttattttgtgaaccttaactccaacgctggtattagtcaactctataaggatagtgacaacaagttgctctggggtggagctcaacaagagcgggatggctggatgtggtgcttcatggtcgatctacaataccgcatgttctattctgacagtaaattcgttggttctccaagggattgtggcctctcctctgtctttttgacagagcgcccgagttgaaacagctattgtgaggaggggagcagttctggaccggccgtgcgaaataagtaatgagtatcaaagtgtttctgtgatctatgaaatttagagggccaggatacaattattgatcaactcccacaaaaaaaaaaaaaa

SEQ ID NO: 356 - DNA, 942 bp, Blastomyces dermatiditis, S63772
ggatccatatcatgagaagtatgattgggatctctggaataagtggtgcaacaaggacccctacaactgcgactgggacccatctcatgagaagtatgattgggatctctggaataagtggtgcaacaaggacccctacaactgtgactgggacccatatcatgagaagtatgattgggatctctggaataagtggtgcaacaaggacccctacaactgtgactgggacccatatcatgagaagtatgattgggatctctggaataagtggtgcaacaaggacccctacaactgtgactgggacccatctcatgagaagtacgattgggatctctggagtaagtggtgcaacaagcacgacgagcacgacaaacatccattgtgccctgtctgtgaccccctctcaggcaaaaatcactgtcatccaaccacttcctgtgtcagcacaggccaccactaccactgcgcctgccgcgctggctacaaggctagccattatagccatgaccacaagcatttccgcatgccagtcaaaggctatgaattccttgttttcaccggcccgcataccaagtgcaatgtcctttgcgacggttacccgcacaagccagcccatgagctttgcggcgaggttaaggttcataattattgcgggccatgagcttcctttgagggaaagcgcagaaagagggaaatttggggtgattttggagtacttgaacagatttattttcctcgttttgagggagggagaaagcgaacatgtaattttgtagatgggtggaaagcttcatctgacctctggacgaggtcattttttcccttttattatggataaatattgatgaagttggataatagggagacatctttttgcaaaattaatagttatatatatgagttagattaccttcttaattagatgctttaatgatttttgtg

SEQ ID NO: 357 - DNA, 912 bp, Blastomyces dermatiditis, AF277079
atgcatctctcttctatattcattggtgctctcactgcactcatctctgttgttcatgcagagagtgtgattgcaaagagagcagacttgggcagtgcttttgtatttgtttattgcaatttcagcgtcgctctcgatattcaggctggcgaaactagcacccggaaaatccttgacggccgatcttatgattaccacaatgagaaatatagacgcggcggcggcgatggcgtcagtttaacactacatcacaccgatggtccggacagttccaattcagaaacaacgttccgctataaattagccgacgataattcgactgtcgagtacagtttggggaattcaggtggtaacccatttgcaggccataaaatcactctcaagtcctcgggtgacgattgccccagtattgaatggccggaaggcattccgacaggcgtaagcagtggctcctgcggatctagcgaaaattcgattttgacgatgtgcccaccgggaacatctctggatgattttgaggatgagtaaaattaaaatggtatgatgtgacttctctgtcttttttttcactcgtgatttgatgagtattttgagtttgatcatgctaataattgagagataagaaaatgaaacctttttgtttcatgattagacatagtcacctgtcaacttctcttaacattagttgaatttctcaatgtgagattatgaagagatcaggcaatcagtgacataatttaagttagagctcatgctaataagcattaaaacattgtttgagatattttatcaatgtatttaattattaaagacagatgttaattttctctcttctatctttattaattttttttttcattaactcttattctcttattttatatataaagtatgcctctgtattatgataac

SEQ ID NO: 358 - DNA, 1234 bp, Coccidioides immitis, U32518
ctctccctcccccttagtccttcagttattttccttccccatataaaaacatacattcgtttcgtggtccatcaaagactatcgttaattctccaaccccggttgtcgttttttttgctgtactattagggaggataatcgttctcgtccgttagacgcacatacataatcaaaatgcagttctctcacgctctcatcgctctcgtcgctgccggcctcgccagtgcccagctcccagacatcccaccttgcgctctcaactgcttcgttgaggctctcggcaacgatggctgcactcgcttgaccgacttcaagtgccactgctccaagcctgagctcccaggacagatcactccttgcgttgaggaggcctgccctctcgacgcccgtatctccgtctccaacatcgtcgttgaccagtgctccaaggccggtgtcccaattgacatcccaccagttgacaccaccgccgctcccgagccatccgagaccgctgagcccaccgctgagccaaccgaggagcccactgccgagcctaccgctgagcccaccgctgagccgactcatgagcccaccgaggagcccactgccgtcccaaccggcactggcggtggtgtccccactggcaccggttccttcaccgtcactggcagaccaactgcctccaccccagctgagttcccaggtgctggctccaacgtccgtgccagcgttggcggcattgctgctgctctcctcggtctcgctgcctacctgtaaatttagactatcagcaaaactgacaagcacgtcgccatggcgtcaattattccccccgcgcatttttcccagttcatttttttctcgacaacaattcagcacgcattggaaggcgaaatgacccggatgtccgcaacacgataaaaggtttcacgatctctcttctctgctctcccctctctgggaggctctaagtttcatttggattgaaatggggcgatgggcaatcgttcgttgggggtgaagggagtggggatctgggattcgggattcccgaaagtcaaaaacgctttattctgcgatgtgaccacggctatgggtgtacaatgttgtgtctgtgacttttttacggggggggagaaacgaatataacacacctgatttcacttcacacttattacttatcctgtatctaattgacatctgggaaagggagcttatttccctgttaataatttggtgttatattttgtta

SEQ ID NO: 359 - DNA, 965 bp, Coccidioides immitis, AF022893
atagagggcgtacttcagtgttgcattattgttatttgtttctttttctctaaacacagattggagttcgtcgcactgttatatcttttgataccgggatacggttctttaatcgttggattattctcgacgcgccagatctctccgatgcctatctccaacctggcgatcaccgctcttgagaattaactgcttccggagaaattccattattatctcacaatgtggttaggttggctgccggctgtatttgtacttgttgccggcggggctgcggagaaggtaaaaccgataaaagctgatttgcagatggcatttcttcctgattaactgatgcgcatacgcgctaggttctattactaacgtgtattggtactgacaggaatgggccttctcacctccatactatccttcaccttgggcttcgggccagggagaatggagcgaggcatataacaaagcgcgcgaattcgtctctcaattaacactcacagagaaagtgaacctcacgaccggcgttgggtagatcctcgcgtgccttatttcctatcaacaaagcagttcgctgatttctcacaggtggatgcaagaagcttgtgttggcaatgtaggatcaattcctcgactaggatttcgttcattatgcatgcaggacggacctcttggtattcgtttcggtatgaatttatttcgcctctgatcgccagacaatatgagctgtgctaacgcagagtagcggaccatgtcagtgcttttccggcgggtatcaacgtaggagcgacgtggagcaaaagtttggcatacttgcgtggaaaggcgatgggagaagaacaccgtgacaaaggagttgatgtgcaattgggacctgctgtcggaccgttgggcaggtctcccgatggaggtcgtaactgggaaggctttagtcctgacccggtgctgtcgggatatctggtcgctgaaacgat

SEQ ID NO: 360 - DNA, 735 bp, Cryptosporidium parvum, AY471868
ctgaggaaactggtatgactgatgctgcaacacaaacaattccaatagttactcagacttcaactgctaaaccactttcaaagagtgaacttaagaaaatcgagaaattggaaaaggaaaagttgaaaaaagaaaagaagctattggctaagcaggagaaggaaagacagagattacagaaattagaagagaaagagagaaagaaagcattaaaggaagcaaacaagaagtcttcatccgacaagaatgaagccaatgatgctaaactcttgaaaaaacaagaaaaagagaaacaaaagagattaagggaggaggagaaagaagaacaaagaagattgaaagaacaaaagagattggaaaaagaaaagaaaaaacaaaaattacccaaagataatgagaaacagaaattatctaaagaagagaagcagagacaaaagcaattggaaaaagaagagaggcaaagacaaaaacaattacaaaaagaagagaaacagagacaaaaattgttgaagcaagaggagaaacagagacaaaaacaattacaaaaagaagagaagcaaaaacaaaaactattgaaacagcaaaagaaggaagcatctaataatggtttaaaggatcatgttaaaccatcaaatgaaggtaaggaacaaaagaagcaagataagaaaaagactaaggcagaaaaagaattaaaggagaacgaagaaggtgaatcatcttcatgcagttcaaaaa

SEQ ID NO: 361 - DNA, 375 bp, Cryptosporidium parvum, AF529280
ttgaattcattaataaaatctacagaatttgaaaatgaaacagacttgatgaaagtaataatgaagagttctggcccaatctacaacaatgcatcccagatttggaatcatacgttctactggagctgtttaaggtctccatcagaaactaataagccaacttcaaaggtttcaaagttgattgaagagtcttttggaagttttgagtcattcaaggagtcatttaccgctaatgcaactggtcattttggatcaggttggatttgggtagttattgacccaattaacaatcaaaaacttaaaattgtccaaactcatgatggtgacaatcctgagaagctcggacttggaaaaccagttctaacctgtgatgta

SEQ ID NO: 362 - DNA, 812 bp, E. coli 0157:H7, 16445223:c3136459-3133832
gaagatctgatcacccaggaagatgtggtcgtgacgctctctcaccagggctacgttaaatatcagccgctttctgaatacgaagcgcagcgtcgtggcgggaaaggtaaatctgccgcacgtattaaagaagaagactttatcgaccgactgctggtggcgaacacgcacgaccatattctgtgcttctccagccgtggtcgcgtctattcgatgaaagtttaccagttgccggaggccactcgtggcgcgcgcggtcgtccgatcgtcaacctgctgccgctggagcaggacgaacgtatcaccgcgatcctgccggtgaccgagtttgaagaaggcgtgaaagtcttcatggcgaccgctaacggtactgtgaagaaaaccgtcctcaccgagttcaaccgtctgcgtaccgccggtaaagtggcgatcaaactggttgaaggcgatgagctgatcggcgttgacctgaccagcggcgaagacgaagtaatgctgttctccgccgaaggtaaagtggtgcgctttaaagagtcttctgtccgtgcgatgggctgcaacaccaccggtgttcgcggtattcgtttaggcgaaggtgataaagtcgtctctctgatcgtgcctcgtggcgatggcgcaatcctcaccgcaacgcagaacggttatggtaaacgtaccgcagtggcggaatacccgactaagtcgcgtgcgacgaaaggggttatctccatcaaggttaccgaacgtaacggtttagttgttggcgcggtacaggtagatgactgcgaccagatcatgatgatcaccgatgc

SEQ ID NO: 363 - DNA, 660 bp, E. coli 0157:H7, 12518283:3562-4221
atgaagaaacgtgtttatcttattgccgccgtagtgagtggcgctctggcggtatctggctgcacaactaacccttacaccggcgaacgcgaagcaggtaaatctgctatcggcgcaggtctgggctctctcgtgggcgcgggtattggtgcgctctcttcttcgaagaaagatcgcggtaaaggcgcgctgattggcgcagcagcaggcgcagctctgggcggcggcgtgggttattacatggatgtgcaggaagcgaagctgcgtgacaaaatgcgcggcactggtgttagcgtaacccgcagcggggataacattatcctcaatatgccgaacaatgtgaccttcgacagcagcagcgcaaccctgaaaccggcgggcgctaacaccctgaccggcgtggcaatggtgctgaaagagtatccgaaaacggcggttaacgtgattggttatactgacagcacgggtggtcacgatctgaacatgcgtctctcccagcagcgtgcggattccgttgccagcgcgttgatcacccagggcgtggacgccagccgcatccgtactcagggccttggcccggctaacccaatcgccagcaacagcaccgcagaaggtaaggcgcaaaaccgccgtgtagaaattaccttaagcccgctgtaa

SEQ ID NO: 364 - DNA, 812 bp, Salmonella enterica, 29136667:70224-72860
gaagatctgattagccaggaaaatgttgtcgtaaccttgtctcatcagggctatgtgaaatatcagccgttaaccgattacgaagcacagcgtcgtggcggtaaaggcaaatcagcagcacgtattaaagaagaagactttatcgaccgcctgctggtggccaacacccatgacaccatcctttgcttctccagccggggccgtctgtactggatgaaggtctatcagttgccggaagccagccgtggcgcgcgcggtcgtccgatcgttaacctgctgccgctggaagccaacgaacgtatcaccgcgattctgccggttcgtgagtacgaagaaggcgtcaacgtctttatggcgaccgccagcggtaccgtgaagaaaacggcgctgaccgaattcagccgtccgcgttccgccggtattatcgcggtaaacctcaacgacggcgacgagctgattggcgttgacctgacttctggttctgacgaagtcatgctgttctcggccgcgggtaaagtggtgcgcttcaaagaagacgccgtccgtgcgatggggcgtaccgcgaccggtgtgcgcggtattaagctggcgggagacgataaagtagtttctctgatcatcccacgcggcgaaggcgctattctgaccgtaacgcaaaacggctacgggaagcgtaccgcagcggacgagtacccgaccaagtctcgtgcgacgcagggcgttatctctatcaaagtgaccgagcgcaacggttccgttgtcggtgcggtacaggtagacgattgcgaccagatcatgatgatcacggatgc

SEQ ID NO: 365 - DNA, 904 bp, Salmonella enterica, 16502231:c18055-17003
gtgctaaactgggctggtctcagtaccatgacaccggcttcattcacaatgatggcccgactcatgaaaaccaactgggcgcaggtgcttttggtggttaccaggttaacccgtacgttggctttgaaatgggctacgactggttaggccgtatgccgtacaaaggcgacaacaccaatggcgcttataaagctcagggcgttcagttgaccgctaaactgggttatccaatcactgacgatctggacgtttatacccgtctgggtggtatggtatggcgtgcagacaccaagtctaacgtccctggcggcgcgtctactaaagaccacgacaccggcgtttccccggtattcgcgggcggtatcgagtatgccatcacccctgaaatcgcaacccgtctggaataccagtggactaacaacatcggtgatgccaacaccatcggcacccgtccggacaacggcctgctgagcgtaggtgtttcctaccgtttcggccagcaagaagctgctccggtagtagctccggcaccggctccggctccggaagtacagaccaagcacttcactctgaagtctgacgtactgttcaacttcaacaaatcgaccctgaagccggaaggccagcaggctctggatcagctgtacagccagctgagcaacctggatccgaaagacggttccgttgtcgttctgggcttcactgaccgtatcggttctgacgcttacaaccagggtctgtccgaaaaacgtgctcagtctgttgttgattacctgatctccaaaggtattccgtctgacaaaatctccgcacgtggtatgggcgaatctaacccggttaccggcaacacctgtgacaacgtgaaacctcgcgctgccctgatcgattgcctggctccggatcg

SEQ ID NO: 366 - DNA, 907 bp, Shigella dysenteriae, 46943:568-1623
gtgctaaactgggctggtcccagtaccatgacactggtttcatcgacaacaatggcccgacccatgaaaaccaactgggcgctggtgcttttggtggttaccaggttaacccgtatgttggctttgaaatgggttacgactggttaggtcgtatgccgtacaaaggcagcgttgaaaacggtgcatacaaagctcagggcgttcagttgaccgctaaactgggttacccaatcactgacgacctggacgtgtacactcgtctgggtggtatggtttggcgtgcagacaccaaagctcacaacaatgtgacaggtgaatctgagaaaaaccacgataccggcgtttctccggtattcgcaggtggtgttgaatgggccatcactcctgaaatcgctacccgtctggaataccagtggaccaacaacatcggtgacgcacacaccatcggcactcgtccggacaacggcctgctgagcttgggtgtttcctaccgtttcggtcagggcgaagcagctccagtagttgctccggctccagctccggcaccggaagtacagaccaagcacttcactctgaagtctgacgttctgttcaacttcaacaaagcaaccctgaaaccggaaggtcaggctgctctggatcagctgtacagccagctgagcaacctggatccgaaagacggttccgtagttgttctgggttacaccgaccgcatcggttctgacgcttacaaccagggtctgtccgagcgccgtgctcagtctgttgttgattacctgatctccaaaggtatcccggcagacaagatctccgcacgtggtatgggcgaatccaacccggttactggcaacacctgtgacaacgtgaaacagcgtgctgcactgatcgactgcctggctccggatcg

SEQ ID NO: 367 - DNA, 812 bp, Shigella flexneri, 30041918:c2708-81
gaagatctgatcacccaggaagatgtggtcgtgacgctctctcaccagggctacgttaaatatcagccgctttctgaatacgaagcgcagcgtcgtggcgggaaaggtaaatctgccgcacgtattaaagaagaagactttatcgaccgactgctggtggcgaacacgcacgaccatattctgtgcttctccagccgtggtcgcgtctattcgatgaaagtttaccagttgccggaagccactcgtggcgcgcgcggtcgtccgatcgtcaacctgctaccgctggaacaggacgaacgtatcaccgcgatcctgccggtgaccgagtttgaagaaggcgtgaaagtcttcatggcgaccgctaacggtactgtgaagaaaaccgtcctcaccgaattcaaccgtctgcgtaccgccggtaaagtggcgatcaaactggttgacggcgatgagctgatcggcgttgatctgaccagtggcgaagatgaagtaatgctgttctccgccgaaggtaaagtggtgcgctttaaagagtcttctgtccgtgcgatgggctgcaataccactggtgtgcgcggtattcgcttaggtgaaggcgataaagtcgtctctctgatcgtgcctcgtggcgatggcgcaatcctcaccgcaacgcaaaacggttacggtaaacgtactgcagtggcggaatacccaaccaagtcgcgtgcgacgaaaggggttatctccatcaaggttaccgaacgtaacggtttagtggttggcgcggtgcaggtagatgactgcgaccagatcatgatgatcaccgatgc

SEQ ID NO: 368 - DNA, 898 bp, Shigella flexneri, 24051234:c4458-3340
gtgctaaactgggctggtcccagtaccatgacactggttttattcctaacaatggtccgacccacgaaaaccaactgggtgcaggtgcttttggtggttaccaggttaacccgtatgttggttttgaaatgggttacgactggttaggtcgtatgccgtacaaaggcgacaacatcaacggcgcatacaaagctcagggcgttcagctgaccgctaaactgggttacccaatcactgacgatctggacatctacactcgtctgggtggtatggtatggcgtgcagacaccaaggctaacgtacctggtggcgcatcctttaaagaccacgacactggcgtttctccggttttcgcaggtggtgttgagtacgcgatcactcctgaaatcgctacccgtctggaataccagtggaccaacaacatcggtgacgcaaacaccatcggtactcgtccggacaacggtctgctgagcctgggtgtttcctaccgtttcggtcagggcgaagcagctccggtagttgctccagctccggcaccggaagtacagaccaagcacttcactctgaagtctgacgttctgttcaacttcaacaaagcaaccctgaaaccggaaggtcaggctgctctggatcagctgtacagccagctgagcaacctagatccgaaagacggttccgtagttgttctgggttacactgaccgcatcggttctgacgcttacaaccagggtctgtccgagcgccgtgctcagtctgttgttgattacctgatctccaaaggtatcccggcagacaagatctccgcacgtggtatgggcgaatccaacccggttactggcaacacctgtgacaacgtgaaacagcgtgctgcactgatcgactgcttggctccggatcg

SEQ ID NO: 369 - DNA, 887 bp, Vibrio cholerae, 15640032:1330207-1332891
gaagagctgatcgctcgtgaagatgtggttgtgactctgtcacacgaaggttatgtgaagtatcaattactgagcgactacgaagcacagcgtcgtggtggtaaaggtaagagcgcaaccaagatgaaagaagaggactacattgagcgtcttctggttgccaatactcacgataacattctgctgttctcgactcgcggcaaaacttaccgtatgaaggtataccaactgccgctcgccagccgtactgcgcgtggtaagccaatcgtgaacctgcttcctctggaagaaaacgagcgcatcaccgcgattctgccagtgactgagtttagtgaagataaattcatcttcatggcaaccggtgacggtactgtgaagaaaacatcgctggatcagtttgccaacgttcgtgcgaatggtttgattgcgctcaacctgcgtgacgaagactcgctgattggtgtggatatcaccgatggcgaaagcgaaattatgctgttctctaaattcggtaaagtggttcgctttaaagagtccgaagaaaccgcggttgtggatgaaaatggtcaacctgtgctggatgaaaatggccagccagagatcaagttcaaaggcgtaagaccaatgggtcgtaccgctgcgggtgttcgcggcatgaaactggctgatggcgaccaagtggtatcgctcatcgtgccgaagaccgaaggtgacgtactcaccgtaactgaaaatggttacggcaaacgtaccagcctatctgaatacccaaccaaaggtcgtggaactcagggtgtggtttcgatcaaagtctctgagcgtaacggcagcgttgtgggtgcagtacaagtggccgagggtgatgagttcatgatgatcaccaatgc

SEQ ID NO: 370 - DNA, 942 bp, Vibrio cholerae, 6031221:1022-1987
atgaaaaagctagcggcaattatttcagcgacgttactttttgcttcttctgcggcagtggcagaggtgtatgtcggaggtaaggtcggtaaatcttggttggatgacgcgtgtctagctggtcaatcttgtgaagatgatgatcaggttgtaggcgcgtttctgggttaccaagcaaacaaatggctctctctggaagcaggctacgactacttaggtaagtttactgctgctggattgaatgatgagaaggtacaagcggtaacgctagcaccaaaactcagcattcctctgaccgaaggcattgcgctgtacggtaaagtgggtggtgcttatgtcgattacggcagcaaggacgactactcatacctaggtgcagcaggcctagagttcaacactaaccacaatgtcactatgcgtttggaataccaaaacctgactgacattaataacgacatcgtacgtgcacgcgcagaaaccgctacactcggtatcgcttataagttcggtggcagtgaagagccagcaccagtggtagaacagcgtccagctgagcctgcacctgttgccgcaccagtcgagaaagtggcagtcactaaaacctttactttccaacatctggatagcagcacctttgctactgcaagtgctgagctaaaaccagcaacggttcagaagctggataaaattgtgggttacctaaaccaatacccacaagcaaaagtagaagtagttggtcacacagactcaacaggttctgaagcttacaaccaaaaactgtctgagcgtcgtgctcaagcagtagcgaaagcactagaagctcaaggtattgatgcatctcgtatttcagctaaaggtctaggcgaaagcagcccaatcgcttctaacgcgacagcagaaggtcgtgagaagaaccgtcgtgttgagctagtgatccctgaa

SEQ ID NO: 371 - DNA, 400 bp, Staphylococcus aureus, AF467080
gcaaatggtgtaggtaagacaactttacttgaagctatttaccaccaaatagagggaattgattgttctcctaaagtgcaaatggcatactatcgtcaacttgcttatgaagacatgcgtgacgtttcattattgcaatatttaatggatgaaacggattcatcagaatcattcagtagagctattttaaataacttgggtttaaatgaagcacttgagcgttcttgtaatgttttgagtggtggggaaagaacgaaattatcgttagcagtattattttcaacgaaagcgaatatgttaattttggatgaaccaactaattttttagatattaaaacattagaagcattagaaatgtttatgaataaatatcctggaatcattttgtttacatcacatg

SEQ ID NO: 372 - DNA, 652 bp, Staphylococcus aureus, AF142100
atggaggtgtagaaggtgttatcatcttttttaatgttaagtataatcagttcattgctcacgatatgtgtaatttttttagtgagaatgctctatataaaatatactcaaatgttacgaaagacttagcaattaatgttaatcagtttgagacctcaaatataacgtatatgattcttttgatatgggtatttggtagtttgttgtgcttattttatatgattaaggcattccgacaaattgatgttattaaaagtttgtcattggaatcgtcatatcttaatgaacgacttaaagtatgtcaaagtaagatgcagttctacaaaaagcatataacaattagttatagttcaaacattgataatccgatggtatttggtttagtgaaatcccaaattgtactaccaactgtcgtagtcgaaaccatgaatgacaaagaaattgaatatattattctacatgaactatcacatgtgaaaagtcatgacttaatattcaaccagctttatgttgtttttaaaatgatattctggtttaatcctgcactatatataagtaaaacaatgatggacaatgactgtgaaaaagtatgtgatagaaacgttttaaaaattttgaatcgccatgaacatatacgttatggtgaatcgat

SEQ ID NO: 373 - DNA, 611 bp, Streptococcus pyogenes, U70055
aatatgggcagggcaagcagtatcattaatcactagtgccatcttgcaaatggcgattattttttaccttacagaaaaaactggatccgcgatggtcttgtctatggcttcactattaggttttttaccctatgcggtctttggacctgcaattggtgtgctagtggatcgtcatgataggaagaagataatgattggtgctgatttaattatcgcagcagctggttcggtgcttactattgttgcattctatatggagctacctgtctggatggttatgatagtattgtttatccgtagcattggaacagcttttcacaccccggctctcaatgcggttacgccacttttagtaccagaagaacagcttacgaaatgtgcaggctatagtcagtctttgcagtctataagctatattgttagtccggcggttgcagcactcttatactccgtttgggaactaaatgctattattgccatcgatgtattgggtgctgtgattgcatctattacggtagcaattgtacgtattcctaagctgggtgatcgcgtgcaaagtttggacccaaatttcataagagaaatgcaagaaggaatggctgtactacggc

SEQ ID NO: 374 - DNA, 732 bp, Streptococcus pyogenes, 2190969:211-942
atgaaacagaaaaacccgaaaaatacgcaaaatttcattacatctaaaaagcatgtaaaggaaatattaaaatatacgaatatcaataaacaagataaaataatagaaattgggtcaggaaaaggacattttaccaaggaacttgtggaaatgagtcaacgggtgaatgctatagagattgatgaaggtttatgtcatgccacgaaaaaagcagttgaaccttttcagaatataaaagttattcatgaggatattttgaagtttagctttcctaaaaatacagactataaaatatttggtaatattccctacaatattagtactgatattgtaaaaaagattgcttttgatagtcaagcgaaatatagctaccttattgtagagaggggatttgctaaaaggttgcaaaatacccaacgagctttaggtttgctgttaatggtggaaatggatataaaaattcttaaaaaagtgccacgagcatattttcaccctaagcctaatgtagattctgtattgattgtacttgaaaggcataaaccatttattttaaagaaggactacaaaaagtatagatttttcgtttataaatgggtaaacagggaatatcatgttctttttactaaaaatcaattaagacaggtgctgaagcatgcgaatgttactgatcttgataaattatccaatgaacaatttttgtctgttttcaatagttacaaattatttcaataa

SEQ ID NO: 375 - DNA, 763 bp, Streptococcus pyogenes, 38707181:8545-9307
gatgtatcacttcaggagtgattacatgaacaaaaatataaaatattctcaaaactttttaacgaatgaaaaggtactcaaccaaataataaaacaattgaatttaaaagaaaccgataccgtttacgaaattggaacaggtaaagggcatttaacgacgaaactggctaaaataagtaaacaggtaacgtctattgaattagacagtcatctattcaacttatcgtcagaaaaattaaaactgaacattcgtgtcactttaattcaccaagatattctacagtttcaattccctaacaaacagaggtataaaattgttgggaatattccttaccatttaagcacacaaattattaaaaaagtggtttttgaaagccatgcgtctgacatctatctgattgttgaagaaggattctacaagcgtaccttggatattcaccgaacactagggttgctcttgcacactcaagtctcgattcagcaattgcttaagctgccagcggaatgctttcatcctaaaccaaaagtaaacagtgtcttaataaaacttacccgccataccacagatgttccagataaatattggaagctatatacgtactttgtttcaaaatgggtcaatcgagaatatcgtcaactgtttactaaaaatcagtttcatcaagcaatgaaacacgccaaagtaaacaatttaagtaccgttacttatgagcaagtattgtctatttttaatagttatctattatttaacgggaggaaataa

SEQ ID NO: 376 - DNA, 1560 bp, Rickettsia prowazekii, 3860572:c187837-186278
atgccaaacaatgatttgaaaacacctccactttctaaaaagcaattattggcttttttcggtatgattgttggcatgtttatgtcagtacttgatattcaaattgttgctagctcattatctgtaatagctgctggtcttgctgcttcaagcgatgaactttcttgggttcaaacatcgtacttaatagctgaagttatcattattcctattaccggatttttagcaagattactttcgaccagaatctgttattttattgcagctttaggatttactattatgagtgtattatgttcgcttgcaaataatattgaatctatgattatctttagggcattacaaggattctttggcggcgctatgataccgctagtctttagtacagtttatatcatttttcctgcatcacaacgtcctacagttactatcttaattggacttgtcgtaactgttgcaccgactttaggacctacgctcgggggatatattacggagattttatcatggcattttatgtttttattaaacgtcataccaggtattttcgtatgcactgtagtattcttgtatgtgaattttgataaaccaaattatcaattactaaaaaattttgattttcttggtatattattaatgtctttaactcttggattattacagtatgttttagaagaaggcaataaagaaggttggcttgacgataatctaatattattcttaagcattacagtagctttaggttttattttattaattattcgagaattaacatttattaacccaattttagatttaaaaacattcctttataaagactttacttttggctgcatttattcattcgttatgggtatcgggttatacggtgcagtatatatattaccactatttctctttactattgctgaatatgatacattacaaattggtgctactatgatggtaacaggtgtagcgcaatttttatccgcaccactcgcaggcagaatgttagggctaggtatagatttacgcatgatgcttactatagggctaggaggattcgcgcttggatgtcatttgaatagttgtctaacacctgattctaaatttgctgcctttatacttccacaatttgttagagggttttccttaatgttttgttttataccgactaataatatagctcttggcaacatgcccaaagaaaaagtaggtaatgctagtgggctttataatcttactcgtaatttaggaggagcagtaggacttgcaataatcagtactatacttagtaacgatactaaaatcttcatgcaatatttatcagaaaatatatcgtatacttctataatagcattaacgcgactagattcctatactgaattattaagcgggaaaattcttaatcctgaacaaggatcatatttgttattagcaaacaaattaaataatgatgcttttgtaattgcaataaataatatatttaatatgataggattattatttgtatttataatgctactaataccttttacctcaaatattaaattaaccgaaaatgttaatgttcactaa

SEQ ID NO: 377 - DNA, 1947 bp, Streptococcus pneumoniae, X83917
atgacagaagaaatcaaaaatctgcaggcacaggattatgatgccagtcaaattcaagttttagagggcttagaggctgttcgtatgcgtccagggatgtacattggatcaacctcaaaagaaggtcttcaccatctagtctgggaaattgttgataactcaattgacgaggccttggcaggatttgccagccatattcaagtttttattgagccagatgattcgattactgttgtggatgatgggcgtggtatcccagtcggtattcaggaaaaaacaggtcgtcctgctgttgagaccgtctttacagtccttcactctggaggaaagttcggcggtggtggatacaaggtttcaggtggtcttcacggggtggggttgtcagttgttaatgccctttccactcaattagacgttcatgtccataaaaacggtaagattcattaccaagaataccgtcgtggtcatgttgtcgcagatcttgaaatagttggagatacggataaaacaggaacaactgttcacttcacaccggacccaaaaatcttcactgaaacaacaatctttgattttgataaattaaataaacggattcaagagttggcctttctaaatcgcggtcttcaaatttctatcactgataagcgccaaggtttggaacaaaccaagcattatcattatgaaggtgggattgctagttacgttgaatatatcaacgagaacaaggatgtaatctttgatacaccaatctatacagacggtgagatggatgatatcacagttgaggtagccatgcagtacacaacgggttaccatgaaaatgtcatgagtttcgccaataatattcatacacatgaaggtggaacgcatgaacaaggtttccgtacagccttgacacgtgttatcaacagttatgctcgtaagaataagttactgaaagacaatgaagacaatctaacaggggaagatgttcgcgaaggcttaactgcagttatctcagttaaacacccaaatccacagtttgaaggacaaacgaagaccaaattgggaaatagcgaagtggtcaagattaccaatcgcctcttcagtgaagccttctccgatttcctcatggaaaatccacagattgccaaacgtatcgtagaaaaaggaattttggctgccaaggctcgtgtggctgccaagcgtgcgcgtgaagtcacacgtaaaaaatctggtttggaaatttccaaccttccagggaaactagcagactgttcttctaataaccctgctgaaacagaactcttcatcgtcgaaggagactcagctggtggatcagccaaatctggtcgtaaccgtgagtttcaggctatccttccaattcgcggtaagattttgaacgttgaaaaagcaagtatggataagattctagctaacgaagaaattcgtagtcttttcacagccatgggaacaggatttggcgcagaatttgatgtttcgaaagcccgttaccaaaaactcgttttgatgaccgatgccgatgtcgatggagcccacattcgtacccttcttttaaccttgatttatcgttatatgaaaccaatcctagaagctggctatgtttatattgcccaaccaccaatctatggtgtcaaggttggaagcgagattaaagaatatatccagccgggtgcagatcaagaaatcaaactccaagaagctttagcccgttatagtgaaggtcgtaccaaaccgactattcagcgttataaggggctaggtgaaatggacgatcatcagctgtgggaaacaaccatggatcccgaacatcgcttgatggctagagtttctgtagatgatgctgcagaagcagataaaatctttgatatgttgatgggggatcgagtagagcctcgtcgtgagtttatcgaagaaaatgctgtctatagtacacttgatgtctaa

SEQ ID NO: 378 - DNA, 2637 bp, Streptococcus pneumoniae, AF503577
gagtttgcttacttcaagaattttctattttcacttggtattttatgggctttgtatcttatgtctaacattcaaaacatgtccctggaggacattatgggagagcgttttgggcgctactccaagtacattattcaagaccgggctttgccagatattcgtgatggattgaagccggttcagcgccgtattctttattcgatgaataaggatggcaatacctttgacaagagctaccgtaagtcggccaagtctgtcgggaatatcatggggaatttccacccacacggtgatagatctatctatgatgccatggttcgtatgtctcaggactggaaaaatcgtgagattctagttgaaatgcatggtaacaacggttctatggacggggatccgcctgcggctatgcgttataccgaagcgcgtttgtctgaaattgctggctaccttcttcaagacatcgataaaaagactgttccttttgcatggaactttgatgatacagagaaagaaccgacagtcttaccagcagcctttccaaacctcttggtcaatggttctactggtatttcggctggttatgccacagacattccacctcataatttagctgaggttattgatgcgacggtttacatgattgaccacccgacagccaaggtggataaactcatggaattcttgcctggaccagattttccgactggaggaatcattcagggtcgtgatgaaatcaagaaggcctatgaaactgggaaagggcgcgtggtcgttcgttccaagacggagattgaaaagctaaaaggtggtaaggaacaaatcgttatcactgagattccttatgaaatcaataaggctaatctggtcaaaaaaatcgatgatgtccgtgtcaataacaaggtggctggaattgctgaggttcgcgatgagtctgaccgtgatggtcttcgcattgctatcgaactcaagaaagacgccaatacggagcttgttctcaattatctattcaaatacactgacctacaaatcaactataactttaacatggtggcgattgacaatttcacgcctcgtcaggttgggattgtcccaatcctgtctagctatatcgcccaccgtcgtgaagtgattttggcacgttcacgctttgacaaggaaaaggctgagaaacgtctccatattgtcgaaggtttgattcgcgtgatttcgattttggacgaagtcattgctctgatccgcgcttctgagaataaggctgacgccaaggaaaacctcaaggtcagctatgagtttacagaagagcaagccgaagctatcgttaccttgcaactttaccgtttgaccaatacagacgtagttgttttgcaggaagaagaagcagaacttcgtgagaagattgctatgcttgtggcgattatcggtgatgaacggactatgtacaatcttatgaagaaagaacttcgtgaggtcaagaagaaatttgcgactccgcgtttgagttctttagaagacactgcaaaagcaatcgaaattgatacagctagtcttattgccgaggaagatacctatgtcagcgtgaccaaggcaggttacatcaagcgtaccagtccacgttcctttgcggcgtccactctggaagaaattggcaaacgtgatgatgatcgtctgatttttgtgcaagctgccaagacaacccaacacctcttgatgttcacgactcttggaaatgtcatctatagaccaatccatgaattggcagatattcgctggaaggacatcggagagcatttgagccagaccatcacaaactttgaaacgaatgaagaaattctttatgcggaagtactggaacagttcgatgatgcgacaacctattttgcggcgactcgtctcggtcaaatcaagcgtgtagaacgaaaagaattcaccccatggcggacctacaagtctaagtcggttaagtatgctaagctcaaagacgagacagaccagattgtagcagtggctccaatcaaactggatgatgttctattgattagtcaaaacggttatgcccttcgtttcaatatcgaagaggttccggttgtcggtgctaaggcagcaggtgtcaaagctatgaatttgaaagaagatgatgttctccaatctgcctttatctgtaatacatcatctttctacctcttgactcagcgtggaagtttgaaacgtgtttcaacagaggaaattccagcaaccagccgtgctaaacgaggacttcaagtcttgcgtgagttgaaaaataaaccgcatcgtgtcttcttagcaggagcagttgcagaacaaggcttcgttggtgacctctttagtacagaagtggacgggaacgaccaaactctgcttgttcaatccaacaaaggaacaatctatgaaagccgattgcaagacttgaacttgtcagaacgcactagcaatggaagcttcatttctgacacgatttcagatgaagaagtttttgatgcttatcttaaagaagtatttactgaaactaaataagtgaaatgaagaatcagttctaagagctggttctttttattgaagaaattttctgaaaattacaaaatatacttgctattttagaaaaatagtgtagaatataag

SEQ ID NO: 379 - DNA, 2008 bp, Streptococcus pneumoniae, 6851036:1255-3198
aaaattttgcaaaatccttggaaaacctgtagaatagtaaagatgaacgaataggaggttccttgtgtcaaaaaaggaaatcaatattaacaattataatgatgatgctattcaggtgctagaagggttggatgcggtccgaaaacgtccggggatgtatattggatcgaccgatggcgctggtcttcatcacctagtttgggaaatcgttgataatgcagtcgatgaagccttgtctgggtttggtgatcgtattgatgtaactatcaataaagacggtagtctaacggttcaagaccatggacgtgggatgccgacaggtatgcacgctatgggaattccaactgttgaggttatctttaccattcttcatgccggagggaaattcggtcaaggtggctataagacatcaggtggacttcacggagtgggttcttccgttgttaacgccctttctagctggttagaagttgaaattacccgtgatggcgcagtttacaagcaacgtttcgaaaatggtggaaaacctgtcacgactttgaagaaaatcggtacagcacccaagtctaaaacaggcaccaaagttacttttatgcctgacgcgactatattttctacgacagatttcaagtacaataccatttcagagcgccttaatgaatcagcctttctcttgaaaaatgtgaccttgtctttaacggacaagcgaacagatgaagcgattgagttccactatgagaatggagtacaagattttgtttcttatctcaacgaagataaggaaatcttgacgccagttctttactttgaaggggaagacaatggttttcaagtggaagtagccctccagtacaatgacggattctcagataacattctatcctttgtcaataacgttcgcaccaaggacggtggaacgcacgagacaggactcaagtctgccattaccaaggtcatgaatgactatgcacgtaaaacaggtcttctcaaggaaaaagataaaaaccttgaaggttcagactatcgtgagggactagcggccgttctttctatcttagttcctgaagaacacttgcagtttgaaggacagaccaaggataaactaggaagccccctagctcgcccagttgtggatggaatagtggctgataagttgacctttttccttatggaaaatggggaattagcttctaacctcatccgcaaggctatcaaggcccgtgatgctcgtgaagcagcacgtaaggcgcgtgatgagagccgaaatgggaagaaaaacaagaaagataagggcttgttgtctgggaaattgaccccagcccaatctaagaatcctgctaagaatgaactctatctagttgagggggactctgccggtggttctgccaaacaaggtcgtgaccgcaagttccaggctattctacctcttcgtggtaaggttatcaatacagccaaggccaagatggcggatatcctcaaaaatgaagagatcaataccatgatttataccattggtgcgggtgttggagcagacttctctattgaagatgccaactatgataagatcattatcatgaccgatgcggataccgacggtgcccatatccagaccttgctcttgacatttttctaccgttacatgcgtccgctagtcgaggcaggtcatgtctatattgccctcccacctctttacaagatgtccaaaggtaaaggaaagaaagaagaagtggcctacgcttggacggacggagaactagaagaactccgtaaacagttcggtaaaggcgctaccctccaacgatacaaaggacttggtgagatgaatgcggaccagctctgggaaacaaccatgaacccagaaacacgtaccctcatccgtgtcacaattgaagatttagcgcgcgccgaacgccgcgtcaatgttctcatgggagataaggtagaaccacgccgtaaatggattgaagataatgtcaagtttacgctagaagaagcgacagtgttttaa

SEQ ID NO: 380 - DNA, 1282 bp, Streptococcus pneumoniae, AF446215
ttcgaccacagggggattgattccatccgtatcctgggagctttcttgcgcaatctgcaaagtaattccctccaaggtggatcaactctcacccaacagttgattaagttgacttacttttcaacctcgacttccgaccagactatttctcgtaaggctcaggaagcttggttagcgattcagttagaacaaaaagcaaccaaacaggaaatcttgacctactatataaataaggtctacatgtctaatggcaactatggaatgcagacagcagctcaaaactactatggtaaagacctcaataatttaagtttacctcagttagccttgctggctggaatgcctcaggcaccaaaccaatatgacccctattcacatccagaagcagcccaagaccgccgaaacttggtcttatctgaaatgaaaaatcaaggttacatctctgctgaacagtatgagaaagcagtcaatacaccaattactgatggactacaaagtctcaaatcagcaagtaattaccctgcttacatggataattacctcaaggaggtcatcaatcaagtagaacaagaaactggctataaccttctaactactgggatggatgtttacacaaatgtagaccaagaagctcaaaaacatctgtgggatatctacaactccgatcaatacgtctcttaccctgacgatgatttgcaagtcgcatctacggtcgtagatgtttcaaatggtaaagtcatcgcccaacttggagctcgtcaccaagcaagtaacgtttcatttggtaccaaccaagctgtggaaaccaatcgtgactggggttctgctatgaaaccaatcaccgattatgcacctgccatagaatacggtgtttatgattccactgcaactatggttaatgatattccttataactatccgggaacaagcacacctgtctacaactgggatagagcatatttcggtaatattactctgcaatatgctcttcaacaatcacgaaatgtcacagccgttgagactttgaataaggtcggtctaggtagagccaaaactttcctaaatggtttaggaatcgactatccaagtattcactactcaaatgccatttcaagtaatactactgaatctagtaaacaatacggtgcaagcagtgaaaaaatggctgcggcttacgctgcattcgctaatggtggtatttaccacaaaccaatgtatatcaataaaatcgtctttagtgatggtagcgaaaaagaattttctgatgctggtacacgagcta

SEQ ID NO: 381 - DNA, 668 bp, Enterococcus faecium, AF375986
tgacgatcaacgggcttaaatggcaaaaagacagttcttggggatcgtatcaagtaactcgtgttagtgatgtgtcacaagtagacttaaaaactgctttgatttattccgataatatatatatggcacaagaaacgttgaaaatgggggagaagaatttccgtgcaggtttggataaattcatttttggtgaagaccttgatttgccaatcagtatgaatccagcacaaatttctaatgaagagagctttaattcagatatcttgttagctgatactggatatggacaaggcgaacttctaattaatcctatccagcaagcagcaatgtattctgtttttgccaacaatggcacacttgtctatcctaaattgattgcagataaagagacaaaagataagaagaatgtcatcggcgaaacagcagtacaaacgatcgtgccagatctgagagaagttgtgcaagatgtaaatggtacagcacattctctttctgctttagggattccattggcagcgaaaactggtacagcggaaatcaaagaaaaacaggatgaaaaagggaaagagaacagtttcttgtttgctttcaaccctgataaccaaggatatatgatggtcagcatgttggaaaataaagaagatgatgattcagcaaccaaacgagca

SEQ ID NO: 382 - DNA, 729 bp, Staphylococcus aureus, 9181834:1-729
atcgatggtaaaggttggcaaaaagataaatcttggggtggttacaacgttacaagatatgaagtggtaaatggtaatatcgacttaaaacaagcaatagaatcatcagataacattttctttgctagagtagcactcgaattaggcagtaagaaatttgaaaaaggcatgaaaaaactaggtgttggtgaagatataccaagtgattatccattttataatgctcaaatttcaaacaaaaatttagataatgaaatattattagctgattcaggttacggacaaggtgaaatactgattaacccagtacagatcctttcaatctatagcgcattagaaaataatggcaatattaacgcacctcacttattaaaagacacgaaaaacaaagtttggaagaaaaatattatttccaaagaaaatatcaatctattaactgatggtatgccacaagtcgtaaataaaacacataaagaagatatttatagatcttatgcaaacttaattggcaaatccggtactgcagaactcaaaatgaaacaaggagaaactggcagacaaattgggtggtttatatcatatgataaagataatccaaacatgatgatggctattaatgttaaagatgtacaagataaaggaatggctagctacaatgccaaaatctcaggtaaagtgtatgatgagctatatgagaacggtaataaaaaatacgatatagatgaataa

SEQ ID NO: 383 - DNA, 846 bp, Staphylococcus aureus plasmid pLW043, 33390917:c41981-41136
ttgaaaaagttaatatttttaattgtaattgctttagttttaagtgcatgtaattcaaacagttcacatgccaaagagttaaatgatttagaaaaaaaatataatgctcatattggtgtttatgctttagatactaaaagtggtaaggaagtaaaatttaattcagataagagatttgcctatgcttcaacttcaaaagcgataaatagtgctattttgttagaacaagtaccttataataagttaaataaaaaagtacatattaacaaagatgatatagttgcttattctcctattttagaaaaatatgtaggaaaagatatcactttaaaagcacttattgaggcttcaatgacatatagtgataatacagcaaacaataaaattataaaagaaatcggtggaatcaaaaaagttaaacaacgtctaaaagaactaggagataaagtaacaaatccagttagatatgagatagaattaaattactattcaccaaagagcaaaaaagatacttcaacacctgctgctttcggtaagactttaaataaacttatcgcaaatggaaaattaagcaaagaaaacaaaaaattcttacttgatttaatgttaaataataaaagcggagatactttaattaaagacggtgttccaaaagactataaggttgctgataaaagtggtcaagcaataacatatgcttctagaaatgatgttgcttttgtttatcctaagggccaatctgaacctattgttttagtcatttttacgaataaagacaataaaagtgataagccaaatgataagttgataagtgaaaccgccaagagtgtaatgaaggaattttaa

SEQ ID NO: 384 - DNA, 486 bp, Staphylococcus aureus plasmid pLW043, 33390917:c2802-2317
atgacattatcaataattgtcgctcacgataaacaaagagtcattgggtaccaaaatcaattaccttggcacttaccaaatgatttaaagcatattaaacaactgaccactgggaatacacttgtaatggcacggaaaacttttaattctatagggaagccattgccaaatagacgtaacgtcgtactcactaaccaagcttcatttcaccatgaaggggtagatgttataaactctcttgatgaaattaaagagttatctggtcatgtttttatatttggaggacaaacgttatacgaagcaatgattgaccaggtagatgatatgtatatcacagtaatagatggaaagtttcaaggagacacattctttccaccatacacattcgaaaactgggaagtcgaatcttcagtagaaggtcaactagatgaaaaaaatactataccgcatacattcttacatttagtgcgtagaaaagggaaatag

SEQ ID NO: 385 - DNA, 1032 bp, Staphylococcus aureus plasmid pLW043, 33390917:34299-35330
atgaatagaataaaagttgcaatactgtttgggggttgctcagaggagcatgacgtatcggtaaaatctgcaatagagatagccgctaacattaataaagaaaaatacgagccgttatacattggaattacgaaatctggtgtatggaaaatgtgcgaaaaaccttgcgcggaatgggaaaacgacaattgctattcagctgtactctcgccggataaaaaaatgcacggattacttgttaaaaagaaccatgaatatgaaatcaaccatgttgatgtagcattttcagctttgcatggcaagtcaggtgaagatggatccatacaaggtctgtttgaattgtccggtatcccttttgtaggctgcgatattcaaagctcagcaatttgtatggacaaatcgttgacatacatcgttgcgaaaaatgctgggatagctactcccgccttttgggttattaataaagatgataggccggtggcagctacgtttacctatcctgtttttgttaagccggcgcgttcaggctcatccttcggtgtgaaaaaagtcaatagcgcggacgaattggactacgcaattgaatcggcaagacaatatgacagcaaaatcttaattgagcaggctgtttcgggctgtgaggtcggttgtgcggtattgggaaacagtgccgcgttagttgttggcgaggtggaccaaatcaggctgcagtacggaatctttcgtattcatcaggaagtcgagccggaaaaaggctctgaaaacgcagttataaccgttcccgcagacctttcagcagaggagcgaggacggatacaggaaacggcaaaaaaaatatataaagcgctcggctgtagaggtctagcccgtgtggatatgtttttacaagataacggccgcattgtactgaacgaagtcaatactctgcccggtttcacgtcatacagtcgttatccccgtatgatggccgctgcaggtattgcacttcccgaactgattgaccgcttgatcgtattagcgttaaaggggtga

SEQ ID NO: 386 - DNA, 324 bp, Staphylococcus aureus plasmid pLW043, 33390917:c21313-20990
atgccttatatttatttaataatagccataagtactgaagttattggaagtgcatttcttaaatcttcagaaggcttttcaaaatttataccatccttaggaacaataatttcatttggaatttgtttctattttttaagtaaaacaatgcaacacctaccactaaatataacttatgcaacttgggcgggactaggtttagtcttaacaaccgtagtctcaataattattttcaaagaacaaataaatctaataactatagtatctatagttttaatcatagtcggcgtagtttcgttaaacattttcggaacatcgcattaa

SEQ ID NO: 387 - DNA, 756 bp, Escherichia coli, AB117036
atgaacatcaacgatgccctcacctccatcctggcctcaaaaaaataccgcgccctttgcccggataccgtgcggcgcatcctgactgaggaatgggggcggcataaatcccccaaacagaccgtagaggctgcacgcacccggctgcatggaatttgcggggcatatgtcaccccggaatcgctcaaggctgctgccgccgcgctttctgcgggcgatgtaaaaaaggcattgtcgctgcatgcctccaccaaggagcgactggccgagctggataccctgtacgattttatcttttcagccgaaactccccgccgcgtgctggatatcgcctgcggtcttaaccccttggcgctatacgagcgcggcattgcatccgtgtggggctgtgatatccaccagggattgggggatgtcatcaccccctttgctagggaaaaagattgggattttacctttgccctgcaggatgtgctgtgtgcgccgcccgccgaagccggcgacctggcgctgatttttaagcttttgcccctgctggagcgggagcaggccggttctgccatggcacttttacaatccctcaataccccgcgcatggctgtcagctttcccacgcgtagtttaggcgggcgtggaaaaggcatggaggcgaactacgccgcatggttcgagggcggcttgcccgccgagtttgagattgaggataaaaagaccatcggaacagaacttatatacttgataaaaaagaatggataa

SEQ ID NO: 388 - DNA, 804 bp, Escherichia coli pMBSF1 plasmid, 25815144:723-1526
ttgaatcgaactaatattttttttggtgaatcgcattctgactggttgcctgtcagaggcggagaatctggtgattttgtttttcgacgtggtgacgggcatgccttcgcgaaaatcgcacctgcttcccgccgcggtgagctcgctggagagcgtgaccgcctcatttggctcaaaggtcgaggtgtggcttgccccgaggtgatcaactggcaggaggaacaggagggtgcatgcttggtgataacggcaattccgggagtaccggcggctgatctgtctggagcggatttgctcaaagcgtggccgtcaatggggcagcaacttggcgctgttcacagcctatcggttgatcaatgtccgtttgagcgcaggctgtcgcgaatgttcggacgcgccgttgatgtggtgtcccgcaatgccgtcaatcccgacttcttaccggacgaggacaagagtacgccgcagctcgatcttttggctcgtgtcgaacgagagctaccggtgcggctcgaccaagagcgcaccgatatggttgtttgccatggtgatccctgcatgccgaacttcatggtggaccctaaaactcttcaatgcacgggtctgatcgaccttgggcggctcggaacagcagatcgctatgccgatttggcactcatgattgctaacgccgaagagaactgggcagcgccagatgaagcagagcgcgccttcgctgtcctattcaatgtattggggatcgaagcccccgaccgcgaacgccttgccttctatctgcgattggaccctctgacttggggttga

SEQ ID NO: 389 - DNA, 837 bp, Escherichia coli pMBSF1 plasmid, 25815144:1526-2362
atgttcatgccgcctgtttttcctgctcattggcacgtttcgcaacctgttctcattgcggacaccttttccagcctcgtttggaaagtttcattgccagacgggactcctgcaatcgtcaagggattgaaacctatagaagacattgctgatgaactgcgcggggccgactatctggtatggcgcaatgggaggggagcagtccggttgctcggtcgtgagaacaatctgatgttgctcgaatatgccggggagcgaatgctctctcacatcgttgccgagcacggcgactaccaggcgaccgaaattgcagcggaactaatggcgaagctgtatgccgcatctgaggaacccctgccttctgcccttctcccgatccgggatcgctttgcagctttgtttcagcgggcgcgcgatgatcaaaacgcaggttgtcaaactgactacgtccacgcggcgattatagccgatcaaatgatgagcaatgcctcggaactgcgtgggctacatggcgatctgcatcatgaaaacatcatgttctccagtcgcggctggctggtgatagatcccgtcggtctggtcggtgaagtgggctttggcgccgccaatatgttctacgatccggctgacagagacgacctttgtctcgatcctagacgcattgcacagatggcggacgcattctctcgtgcgctggacgtcgatccgcgtcgcctgctcgaccaggcgtacgcttatgggtgcctttccgcagcttggaacgcggatggagaagaggagcaacgcgatctagctatcgcggccgcgatcaagcaggtgcgacagacgtcatactag

SEQ ID NO: 390 - DNA, 792 bp, Escherichia coli plasmid p541, 40287459:10986-11777
atgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataa

SEQ ID NO: 391 - DNA, 816 bp, Escherichia coli plasmid pSTOJO1, 17129524:449-1264
atgaataaatcgctcatcattttcggcatcgtcaacataacctcggacagtttctccgatggaggccggtatctggcgccagacgcagccattgcgcaggcgcgtaagctgatggccgagggggcagatgtgatcgacctcggtccggcatccagcaatcccgacgccgcgcctgtttcgtccgacacagaaatcgcgcgtatcgcgccggtgctggacgcgctcaaggcagatggcattcccgtctcgctcgacagttatcaccccgcgacgcaagcctatgccttgtcgcgtggtgtggcctatctcaatgatattcgcggttttccagacgctgcgttctatccgcaattggcgaaatcatctgccaaactcgtcgttatgcattcggtgcaagacgggcaggcagatcggcgcgaggcacccgctggcgacatcatggatcacattgcggcgttctttgacgcgcgcatcgcggcgctgacgggtgccggtatcaaacgcaaccgccttgtccttgatcccggcatggggttttttctgggggctgctcccgaaacctcgctctcggtgctggcgcggttcgatgaattgcggctgcgcttcgatttgccggtgcttctgtctgtttcgcgcaaatcctttctgcgcgcgctcacaggccgtggtccgggggatgtcggggccgcgacactcgctgcagagcttgccgccgccgcaggtggagctgacttcatccgcacacacgagccgcgccccttgcgcgacgggctggcggtattggcggcgctgaaagaaaccgcaagaattcgttaa

SEQ ID NO: 392 - DNA, 436 bp, Escherichia coli strain EU2657, AY517475
caagaagagcgacctggttaactacaatcccattgcggagaaacacgttaacggcacgatgacgctggctgagcttggcgcagcggcgctgcagtatagcgacaatactgccatgaataagctgattgcccatctgggtggtcccgataaagtgacggcgtttgctcgctcgttgggtgatgagaccttccgtctggacagaaccgagcccacgctcaataccgccattccaggcgacccgcgtgataccaccacgccgctcgcgatggcgcagaccctgaaaaatctgacgctgggtaaagcgctggcggaaactcagcgggcacagttggtgacgtggcttaagggcaatactaccggtagcgcgagcattcgggcgggtctgccgaaatcatgggtagtgggcgataaaaccggcagcggagattatggcacc

SEQ ID NO: 393 - DNA, 918 bp, Klebsiella pneumoniae, AY034847
cgttgatgtcactgtatcgccgtctagttctgctgtcttgtctctcatggccgctggctggcttttctgccaccgcgctgaccaacctcgtcgcggaaccattcgctaaactcgaacaggactttggcggctccatcggtgtgtacgcgatggataccggctcaggcgcaactgtaagttaccgcgctgaggagcgcttcccactgtgcagctcattcaagggctttcttgctgccgctgtgctggctcgcagccagcagcaggccggcttgctggacacacccatccgttacggcaaaaatgcgctggttccgtggtcacccatctcggaaaaatatctgacaacaggcatgacggtggcggagctgtccgcggccgccgtgcaatacagtgataacgccgccgccaatttgttgctgaaggagttgggcggcccggccgggctgacggccttcatgcgctctatcggcgataccacgttccgtctggaccgctgggagctggagctgaactccgccatcccaggcgatgcgcgcgatacctcatcgccgcgcgccgtgacggaaagcttacaaaaactgacactgggctctgcactggctgcgccgcagcggcagcagtttgttgattggctaaagggaaacacgaccggcaaccaccgcatccgcgcggcggtgccggcagactgggcagtcggagacaaaaccggaacctgcggagtgtatggcacggcaaatgactatgccgtcgtctggcccactgggcgcgcacctattgtgttggccgtctacacccgggcgcctaacaaggatgacaagcacagcgaggccgtcatcgccgctgcggctagactcgcgctcgagggattgggcgtcaacgggcagtaaggctctgaaaatcatctattggcccaccacc

SEQ ID NO: 394 - DNA, 1140 bp, Klebsiella pneumoniae plasmid, 40548851:1310-2449
atgaaaaaatcgttatctgcaacactgatttccgctctgctggcgttttccgccccggggttttctgccgctgataatgtcgcggcggtggtggacagcaccattaaaccgctgatggcacagcaggatattcccgggatggcggttgccgtctccgtaaagggtaagccctattatttcaattatggttttgccgatattcaggcaaaacagccggtcactgaaaatacactatttgagctcggatctgtaagtaaaactttcacaggtgtgctgggtgcggtttctgtggcgaaaaaagagatggcgctgaatgatccggcggcaaaataccagccggagctggctctgccgcagtggaaggggatcacattgctggatctggctacctataccgcaggcggactgccgttacaggtgccggatgcggtaaaaagccgtgcggatctgctgaatttctatcagcagtggcagccgtcccggaaaccgggcgatatgcgtctgtatgcaaacagcagtatcggcctgtttggtgctctgaccgcaaacgcggcggggatgccgtatgagcagttgctgactgcacggatcctggcaccgctggggttatctcacacctttattactgtgccggatagtgcgcaaagccagtatgcgtacggttataaaaacaaaaaaccggtccgcgtgtcgccaggacagcttgatgcggaatcttacggcgtgaaatccgcctcaaaagatatgctgcgctgggcggaaatgaatattgagccgtcacgggccggtaatgcggatctggaaatggcaatgtatctcgcccagacccgctactataaaaccgccgcgattaaccaggggctgggctgggaaatgtatgactggccgcagcagaaagatatgatcattaacggcgtgaccaacgaggtcgcattgcagccgcatccggtaacagacaaccaggttcagccgtataaccgtgcttcctgggtgcataaaacgggcgcaacaactggtttcggcgcctatgtggcctttattccggaaaaacaggtggcgattgtgattctggcgaataaaaactacccgaataccgaaagagtcaaagctgcacaggctattttgagtgcactggaataa

SEQ ID NO: 395 - DNA, 1146 bp, Klebsiella pneumoniae plasmid, 1212997:1924-3069
atgatgaaaaaatcgttatgctgcgctctgctgctgacagcctctttctccacatttgctgccgcaaaaacagaacaacagattgccgatatcgttaatcgcaccatcaccccgttgatgcaggagcaggctattccgggtatggccgttgccgttatctaccagggaaaaccctattatttcacctggggtaaagccgatatcgccaataaccacccagtcacgcagcaaacgctgtttgagctaggatcggttagtaagacgtttaacggcgtgttgggcggcgatgctatcgcccgcggcgaaattaagctcagcgatccggtcacgaaatactggccagaactgacaggcaaacagtggcagggtatccgcctgctgcacttagccacctatacggcaggcggcctaccgctgcagatccccgatgacgttagggataaagccgcattactgcatttttatcaaaactggcagccgcaatggactccgggcgctaagcgactttacgctaactccagcattggtctgtttggcgcgctggcggtgaaaccctcaggaatgagttacgaagaggcaatgaccagacgcgtcctgcaaccattaaaactggcgcatacctggattacggttccgcagaacgaacaaaaagattatgcctggggctatcgcgaagggaagcccgtacacgtttctccgggacaacttgacgccgaagcctatggcgtgaaatccagcgttattgatatggcccgctgggttcaggccaacatggatgccagccacgttcaggagaaaacgctccagcagggcattgcgcttgcgcagtctcgctactggcgtattggcgatatgtaccagggattaggctgggagatgctgaactggccgctgaaagctgattcgatcatcaacggcagcgacagcaaagtggcattggcagcgcttcccgccgttgaggtaaacccgcccgcccccgcagtgaaagcctcatgggtgcataaaacgggctccactggtggatttggcagctacgtagccttcgttccagaaaaaaaccttggcatcgtgatgctggcaaacaaaagctatcctaaccctgtccgtgtcgaggcggcctggcgcattcttgaaaagctgcaataa

SEQ ID NO: 396 - DNA, 876 bp, Klebsiella pneumoniae plasmid pKP3, 40548851:c1199-324
atggtcagacgttatctcccccttaacccgctgcgcgcctttgaggccgccgcccgtcatctcagtcttacccgcgcggcgattgagctgaatgtcacccatgccgccgtcagccagcaggtcagggcgctggaagaacaactcggctgtgtgctgtttacccgcgtctcgcgcgggctggtgctgacccatgaaggtgagggattactgccggtgctcaatgaggcgtttgaccggattgcggatactctggagtgtttttctcacgggcagttccgtgagcgggtgaaagtcggtgcggtgggaacatttgccgcaggctggctgctgccgcgtctggccggattctatgacagccatccgcatattgatctgcatatctccacccataacaatcatgtggacccggcggcggaagggcatgattatacgatccgtttcggtaacggcgcgtggcatgagtcagatgcggaactgattttcagtgcaccacacgctccgctgtgctcaccggccattgcagaacagttacagcagccggatgatgttcaccgctttaccctgctgcgctcattccgccgggatgaatggagccgctggctggattgtgcgggcggcacaccgccttccccgtcacagccggtaatggtgttcgatacctcactggccatggccgaggcggcacaactgggtgccggggtagcgatcgcaccggtatgtatgttcagccgcctgttacagtcaggcgcactggtacagccgtttgccgcagaaatcaccctcggcggctaccggctgacgcggttacagtcccgtacggaaaccccggccatgcagcaattcgcccgctggctgctgaatacggcggcggcgtaa

SEQ ID NO: 397 - DNA, 840 bp, Plasmid R388, 45795:880-1719
atggtgacggtgttcggcattctgaatctcaccgaggactccttcttcgatgagagccggcggctagaccccgccggcgctgtcaccgcggcgatcgaaatgctgcgagtcggatcagacgtcgtggatgtcggaccggccgccagccatccggacgcgaggcctgtatcgccggccgatgagatcagacgtattgcgccgctcttagacgccctgtccgatcagatgcaccgtgtttcaatcgacagcttccaaccggaaacccagcgctatgcgctcaagcgcggcgtgggctacctgaacgatatccaaggatttcctgaccctgcgctctatcccgatattgctgaggcggactgcaggctggtggttatgcactcagcgcagcgggatggcatcgccacccgcaccggtcaccttcgacccgaagacgcgctcgacgagattgtgcggttcttcgaggcgcgggtttccgccttgcgacggagcggggtcgctgccgaccggctcatcctcgatccggggatgggatttttcttgagccccgcaccggaaacatcgctgcacgtgctgtcgaaccttcaaaagctgaagtcggcgttggggcttccgctattggtctcggtgtcgcggaaatccttcttgggcgccaccgttggccttcctgtaaaggatctgggtccagcgagccttgcggcggaacttcacgcgatcggcaatggcgctgactacgtccgcacccacgcgcctggagatctgcgaagcgcaatcaccttctcggaaaccctcgcgaaatttcgcagtcgcgacgccagagaccgagggttagatcatgcctag

SEQ ID NO: 398 - DNA, 1440 bp, Staphylococcus aureus plasmid pLW043, 33390917:23440-24879
atgaatatagttgaaaatgaaatatgtataagaactttaatagatgatgattttcctttgatgttaaaatggttaactgatgaaagagtattagaattttatggtggtagagataaaaaatatacattagaatcattaaaaaaacattatacagagccttgggaagatgaagtttttagagtaattattgaatataacaatgttcctattggatatggacaaatatataaaatgtatgatgagttatatactgattatcattatccaaaaactgatgagatagtctatggtatggatcaatttataggagagccaaattattggagtaaaggaattggtacaagatatattaaattgatttttgaatttttgaaaaaagaaagaaatgctaatgcagttattttagaccctcataaaaataatccaagagcaataagggcataccaaaaatctggttttagaattattgaagatttgccagaacatgaattacacgagggcaaaaaagaagattgttatttaatggaatatagatatgatgataatgccacaaatgttaaggcaatgaaatatttaattgagcattactttgataatttcaaagtagatagtattgaaataatcggtagtggttatgatagtgtggcatatttagttaataatgaatacatttttaaaacaaaatttagtactaataagaaaaaaggttatgcaaaagaaaaagcaatatataattttttaaatacaaatttagaaactaatgtaaaaattcctaatattgaatattcgtatattagtgatgaattatctatactaggttataaagaaattaaaggaacttttttaacaccagaaatttattctactatgtcagaagaagaacaaaatttgttaaaacgagatattgccagttttttaagacaaatgcacggtttagattatacagatattagtgaatgtactattgataataaacaaaatgtattagaagagtatatattgttgcgtgaaactatttataatgatttaactgatatagaaaaagattatatagaaagttttatggaaagactaaatgcaacaacagtttttgagggtaaaaagtgtttatgccataatgattttagttgtaatcatctattgttagatggcaataatagattaactggaataattgattttggagattctggaattatagatgaatattgtgattttatatacttacttgaagatagtgaagaagaaataggaacaaattttggagaagatatattaagaatgtatggaaatatagatattgagaaagcaaaagaatatcaagatatagttgaagaatattatcctattgaaactattgtttatggaattaaaaatattaaacaggaatttatcgaaaatggtagaaaagaaatttataaaaggacttataaagattga

SEQ ID NO: 399 - DNA, 1215 bp, Vibrio cholerae, 32469306:11605-12819
atgaccaccacacgccccgcgtgggcctatacgctgccggcagcactgctgctgatggctcctttcgacatcctcgcttcactggcgatggatatttatctccctgtcgttccagcgatgcccggcatcctgaacacgacgcccgctatgatccaactcacgttgagcctctatatggtgatgctcggcgtgggccaggtgatttttggtccgctctcagacagaatcgggcgacggccaattctacttgcgggcgcaacggctttcgtcattgcgtctctgggagcagcttggtcttcaactgcaccggcctttgtcgctttccgtctacttcaagcagtgggcgcgtcggccatgctggtggcgacgttcgcgacggttcgcgacgcttatgccaaccgtcctgagggtgtcgtcatctacggccttttcagttcgatgctggcgttcgtgcctgcgctcggccctatcgccggagcattgatcggcgagttcttgggatggcaggcgatattcattactttggctatactggcgatgctcgcactcctaaatgcgggtttcaggtggcacgaaacccgccctctggatcaagtcaagacgcgccgatctgtcttgccgatcttcgcgagtccggctttttgggtttacactgtcggctttagcgccggtatgggcaccttcttcctcttcttctcgacggctccccgtgtgctcataggccaagcggaatattccgagatcggattcagctttgccttcgccactgtcgcgcttgtaatgatcgtgacaacccgtttcgcgaagtcctttgtcgccagatggggcatcgcaggatgcgtggcgcgtgggatggcgttgcttgtttgcggagcggtcctgttggggatcggcgaactttacggctcgccgtcattcctcaccttcatcctaccgatgtgggttgtcgcggtcggtattgtcttcacggtgtccgttaccgcgaacggcgctttggcagagttcgacgacatcgcgggatcagcggtcgcgttctacttctgcgttcaaagcctgatagtcagcattgtcgggacattggcggtggcacttttaaacggtgacacagcgtggcccgtgatctgttacgccacggcgatggcggtactggtttcgttggggctggtgctccttcggctccgtggggctgccaccgagaagtcgccagtcgtctaa

SEQ ID NO: 400 - DNA, 536 bp, Enterococcus faecalis, M85225
cacgccaggacatatggatttcttagcagaagtatatcgttcattatcagttttagatggggcaattctactgatttctgcaaaagatggcgtacaagcacaaactcgtatattatttcatgcacttaggaaaatggggattcccacaatcttttttatcaataagattgaccaaaatggaattgatttatcaacggtttatcaggatattaaagagaaactttctgccgaaattgtaatcaaacagaaggtagaactgtatcctaatgtgtgtgtgacgaactttaccgaatctgaacaatgggatacggtaatagagggaaacgatgaccttttagagaaatatatgtccggtaaatcattagaagcattggaactcgaacaagaggaaagcataagatttcagaattgttctctgttccctctttatcatggaagtgcaaaaagtaatatagggattgataaccttatagaagttattactaataaattttattcatcaacacatcgaggtccgtctgaactttgcggaaatg

SEQ ID NO: 401 - DNA, 502 bp, Escherichia coli partial plasmid, Y19114
tatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagc

SEQ ID NO: 402 - DNA, 555 bp, Listeria monocytogenes, L09756
gctacatttgcgagactcagtcaatatatcagaaaaggaaaaaataaaagttacagaaatgtatacttcaataaatggagaattacgccagatagataaggcagagcctggtgagattattattttaaaaaatgagcttttaaaactaaataacgtacttggagataaaaaaagattaccacatagagaaattcttgagaatcctcttcctatgttacaaacaacaattgaaccatgtaaatcagtacaaagagaaaagttactagatgcactttttgaaatatccgatagtgatccccttctacaatattatgtagatacagtaactcacgaaattgtgctatcttttttaggtgaggtccaaatggaggtaacttgtactctgattcaagaaaaatatcatattgagatagaaacaagaaaaccaactgtcatttatatggaaagaccattaaaaaaatctgaatttaccattgatatcgaagtacctccaaatcctttctgggcttctattggtttatctgtaacaccacttcctttgggtagtggcattca

SEQ ID NO: 403 - DNA, 494 bp, Pseudomonas aeruginosa plasmid RP4, X75761
tggcattctgcattcactcgcccaggcaatgatcaccggccctgtagccgcccggctcggcgaaaggcgggcactcatgctcggaatgattgccgacggcacaggctacatcctgcttgccttcgcgacacggggatggatggcgttcccgatcatggtcctgcttgcttcgggtggcatcggaatgccggcgctgcaagcaatgttgtccaggcaggtggatgaggaacgtcaggggcagctgcaaggctcactggcggcgctcaccagcctgacctcgatcgtcggacccctcctcttcacggcgatctatgcggcttctataacaacgtggaacgggtgggcatggattgcaggcgctgccctctacttgctctgcctgccggcgctgcgtcgcgggctttggagcggcgcagggcaacgagccgatcgctgatcgtggaaacgataggcctatgccatgcgggtcaaggcgacttccggcaagctatacg

SEQ ID NO: 404 - DNA, 550 bp, Pseudomonas sp. plasmid pPSTG2, AF133140
ctcggtggtatctctgctcatgccccgtttatcgccgccgcccttctcaacgggttcgcgttcctgcttgcctgcattttcctcaaggagactcatcacagccatggcgggaccggaaagccggttcgcatcaaaccattcgttctgttacggctggatgatgcattgcgcgggctaggtgcgcttttcgcagttttcttcattattcaactgatcggccaagtgcctgcagccctatgggtcatatatggcgaggaccgttttcagtggaacaccgcgaccgttggtttgtcgctcgcggcgtttggggcaacacatgcgatcttccaagcgtttgttaccggcccgctttcaagccggcttggagagcggcgcacgctgctgtttggcatggctgcggatgcgactggcttcgttcttctggcttttgccacgcagggatggatggtgttcccgattctgttgctgcttgccgccgggggtgttggcatgccggccttgcaggcaatgctctcaaacaatgtcagcagtaacaagcaaggggctttgc

SEQ ID NO: 405 - DNA, 548 bp, Staphylococcus hyicus  (plasmid pSTE1), X60828
ctgggtgaacacagcctttatgttaaccttttccattggaacagctgtatatggaaagctatctgatcaattaggcatcaaaaggttactcctatttggaattataataaattgtttcgggtcggtaattgggtttgttggccattctttcttttccttacttattatggctcgttttattcaaggggctggtgcagctgcatttccagcactcgtaatggttgtagttgcgcgctatattccaaaggaaaataggggtaaagcatttggtcttattggatcgatagtagccatgggagaaggagtcggtccagcgattggtggaatgatagcccattatattcattggtcctatcttctactcattcctatcataacaattatcactgttccgtttcttatgaaattattaaagaaagaagtaaggataaaaggtcattttggatctaaaggaattatactaatgtctgtaggcattgtattttttatgttgtttacaacatcatatagcatttcttttcttatcgttagcgtgctgtcattcctga

SEQ ID NO: 406 - DNA, 571 bp, Transposon Tn10, V00611
agtgctgttgttgtcattaataggcgcatcgctggattacttattgctggctttttcaagtgcgctttggatgctgtatttaggccgtttgctttcagggatcacaggagctactggggctgtcgcggcatcggtcattgccgataccacctcagcttctcaacgcgtgaagtggttcggttggttaggggcaagttttgggcttggtttaatagcggggcctattattggtggttttgcaggagagatttcaccgcatagtcccttttttatcgctgcgttgctaaatattgtcactttccttgtggttatgttttggttccgtgaaaccaaaaatacacgtgataatacagataccgaagtaggggttgagacgcaatcgaattcggtatacatcactttatttaaaacgatgcccattttgttgattatttatttttcagcgcaattgataggccaaattcccgcaacggtgtgggtgctatttaccgaaaatcgttttggatggaatagcatgatggttggcttttcattagcgggtcttggtcttttacactcagtattccaagcc

SEQ ID NO: 407 - DNA, 872 bp, Bordetella pertussis, M13223
atcactactacagcaacgtcaccgccactcgcctgctctccagcaccaacagcaggctatgcgcggtcttcgtcagaagcgggcaaccggtcattggcgcctgcaccagcccgtatgacggcaagtactggagcatgtacagccggctgcggaaaatgctttacctgatctacgtggccggcatctccgtacgcgtccatgtcagcaaggaagaacagtattacgactatgaggacgcaacgttcgagacttacgcccttaccggcatctccatctgcaatcctggatcatccttatgctgagacgcttccccactcgaaccaccgccccgggacagggcggcgcccggcggtcgcgcgtgcgcgccctggcgtggttgctggcatccggcgcgatgacgcatctttcccccgccctggccgacgttccttatgtgctggtgaagaccaatatggtggtcaccagcgtagccatgaagccgtatgaagtcaccccgacgcgcatgctggtctgcggcatcgccgccaaactgggcgccgcggccagcagcccggacgcgcacgtgccgttctgcttcggcaaggatctcaagcgtcccggcagcagtcccatggaagtcatgttgcgcgccgtcttcatgcaacaacggccgctgcgcatgtttctgggtcccaagcaactcactttcgaaggcaagcccgcgctcgaactgatccggatggtcgaatgcagcggcaagcaggattgcccctgaaggcgaaccccatgcataccatcgcatccatcctgttgtccgtgctcggcatatacagcccggctgacgtcgccggcttgccgacccatctgtacaagaacttcactgtccaggagct

SEQ ID NO: 408 - DNA, 792 bp, Clostridium botulinum, 3805779:7268-11143
tgatggaacctccatttgcgagaggtatggggagatattataaagcttttaaaatcacagatcgtatttggataataccggaaagatatacttttggatataaacctgaggattttaataaaagttccggtatttttaatagagatgtttgtgaatattatgatccagattacttaaatactaatgataaaaagaatatatttttacaaacaatgatcaagttatttaatagaatcaaatcaaaaccattgggtgaaaagttattagagatgattataaatggtataccttatcttggagatagacgtgttccactcgaagagtttaacacaaacattgctagtgtaactgttaataaattaatcagtaatccaggagaagtggagcgaaaaaaaggtattttcgcaaatttgataatatttggacctgggccagttttaaatgaaaatgagactatagatataggtatacaaaatcattttgcatcaagggaaggcttcgggggtataatgcaaatgaagttttgcccagaatatgtaagcgtatttaataatgttcaagaaaacaaaggcgcaagtatatttaatagacgtggatatttttcagatccagccttaatattaatgcatgaacttatacatgttttacatggattatatggcattaaagtaaatgatttaccaatcgtaccaaatgaaaaaaaattttttatgcaatctacagatgctatacaggcagaagaactatatacttttgggggacaagatcccagcatcataagtccttctacgg

SEQ ID NO: 409 - DNA, 496 bp, Clostridium botulinum, 3805779:3649-7242
aatatttgggtggcgccagagagatattatggcgaatctttgagtatagatgaagaatataaagttgatgggggaatatatgattctaattttctttcacaagatagtgaaaaagataagttcttacaagccattattactttgttaaaaagaattaatagtactaacgctggggaaaagttattatctttgatttctacagctattccatttccttatggatatataggtggggggtattatgcacctaatatgattacttttggatcagcaccaaaatctaataaaaaattgaattctttaatttcaagtactattccatttccttatgcaggatatagagaaacaaattatctttcatctgaagataataaaagtttctatgcatctaatatagttatttttggtccaggagcaaacatagtagaaaacaatactgttttttataaaaaggaagatgcagaaaatggaatgggaacaatgactgaaatatggt

SEQ ID NO: 410 - DNA, 1000 bp, Clostridium botulinum, X62683
gataaaattgcagatatttctatagttgttccatatataggtcttgctttaaatataggaaatgaagcacaaaaaggaaattttaaagatgcacttgaattattaggagcaggtattttattagaatttgaacccgagcttttaattcctacaattttagtattcacgataaaatcttttttaggttcatctgataataaaaataaagttattaaagcaataaataatgcattgaaagaaagagatgaaaaatggaaagaagtatatagttttatagtatcgaattggatgactaaaattaatacacaatttaataaaagaaaagaacaaatgtatcaagctttacaaaatcaagtaaatgcaattaaaacaataatagaatctaagtataatagttatactttagaggaaaaaaatgagcttacaaataaatatgatattaagcaaatagaaaatgaacttaatcaaaaggtttctatagcaatgaataatatagacaggttcttaactgaaagttctatatcctatttaatgaaattaataaatgaagtaaaaattaataaattaagagaatatgatgagaatgtcaaaacgtatttattgaattatattatacaacatggatcaatcttgggagagagtcagcaagaactaaattctatggtaactgataccctaaataatagtattccttttaagctttcttcttatacagatgataaaattttaatttcatattttaataaattctttaagagaattaaaagtagttcagttttaaatatgagatataaaaatgataaatacgtagatacttcaggatatgattcaaatataaatattaatggagatgtatataaatatccaactaataaaaatcaatttggaatatataatgataaacttagtgaagttaatatatctcaaaatgattacattatatatgataataaatataaaaattttagtattagtttttgggtaagaattcctaactatg

SEQ ID NO: 411 - DNA, 620 bp, Clostridium perfringens plasmid, X60694
atgcgaaaggcatgtctacacgagatatagctactcaagttaatgaaatgtacggcatggatgtttcacctactttaatctcaaatataactgataaaataataccttctataaaagaatggcaatgtaaaccattagaaagtatatatcctatcgtttttatggatgctattcattttaaagttaaaaaagataattctatagttaataaggctgcttacgctgctatcggtgtaaatattgaaggtaaaaagatgttttaggtatttggattggtgctgctgaatcttcaaagtactggttacttgttttaaatgaattaaaaaacagtggagttaaagatattcttatagcttgtatagatggattaaatggctttaaagaagctataaaagccgtatatccgaatactgaggtacaacgttgtattattcaccaaattagaaattctagtcgttatttatcatataaagatattaaagagtttaatgctgatttaaaactagtatatacggctgtaaacgaagatgctgcacttcaagctctaagttctcttgaggagaaatggggagataaatatttacttgctataaaatcttggagaaacaattgggaggagc

SEQ ID NO: 412 - DNA, 1185 bp, Clostridium tetani, 40769:281-4228
cctgataaggaacaaattgccgacgaaattaataatctgaaaaacaaacttgaagaaaaggctaataaagcaatgataaacataaatatatttatgagggaaagttctagatcatttttagttaatcaaatgattaacgaagctaaaaagcagttattagagtttgatactcaaagcaaaaatattttaatgcagtatataaaagcaaattctaaatttataggtataactgaactaaaaaaattagaatcaaaaataaacaaagttttttcaacaccaattccattttcttattctaaaaatctggattgttgggttgataatgaagaagatatagatgttatattaaaaaagagtacaattttaaatttagatattaataatgatattatatcagatatatctgggtttaattcatctgtaataacatatccagatgctcaattggtgcccggaataaatggcaaagcaatacatttagtaaacaatgaatcttctgaagttatagtgcataaagctatggatattgaatataatgatatgtttaataattttaccgttagcttttggttgagggttcctaaagtatctgctagtcatttagaacaatatggcacaaatgagtattcaataattagctctatgaaaaaacatagtctatcaataggatctggttggagtgtatcacttaaaggtaataacttaatatggactttaaaagattccgcgggagaagttagacaaataacttttagggatttacctgataaatttaatgcttatttagcaaataaatgggtttttataactattactaatgatagattatcttctgctaatttgtatataaatggagtacttatgggaagtgcagaaattactggtttaggagctattagagaggataataatataacattaaaactagatagatgtaataataataatcaatacgtttctattgataaatttaggatattttgcaaagcattaaatccaaaagagattgaaaaattatacacaagttatttatctataacctttttaagagacttctggggaaaccctttacgatatgatacagaatattatttaataccagtagcttctagttctaaagatgttcaattgaaaaatataacagattatatgtatttgacaaatgcgccatcgtatactaacgga

SEQ ID NO: 413 - DNA, 948 bp, E. coli 0157:H7, 32400301:1-948
atgaaaataattatttttagagtgctaacttttttctttgttatcttttcagttaatgtggttgcgaaggaatttaccttagacttctcgactgcaaagacgtatgtagattcgctgaatgtcattcgctctgcaataggtactccattacagactatttcatcaggaggtacgtctttactgatgattgatagtggcacaggggataatttgtttgcagttgatgtcagagggatagatccagaggaagggcggtttaataatctacggcttattgttgaacgaaataatttatatgtgacaggatttgttaacaggacaaataatgttttttatcgctttgctgatttttcacatgttacctttccaggtacaacagcggttacattgtctggtgacagtagctataccacgttacagcgtgttgcagggatcagtcgtacggggatgcagataaatcgccattcgttgactacttcttatctggatttaatgtcgcatagtggaacctcactgacgcagtctgtggcaagagcgatgttacggtttgttactgtgacagctgaagctttacgttttcggcaaatacagaggggatttcgtacaacactggatgatctcagtgggcgttcttatgtaatgactgctgaagatgttgatcttacattgaactggggaaggttgagtagtgtcctgcctgattatcatggacaagactctgttcgtgtaggaagaatttcttttggaagcattaatgcaattctgggaagcgtggcattaatactgaattgtcatcatcatgcatcgcgagttgccagaatggcatctgatgagtttccttctatgtgtcaggcagatggaagagtccgtgggattacgcacaataaaatattgtgggattcatccactctgggggcaattctgatgcgcagaactattagcagttga

SEQ ID NO: 414 - DNA, 960 bp, E. coli 0157:H7, 13359151:1-960
atgaagtgtatattatttaaatgggtactgtgcctgttactgggtttttcttcggtatcctattcccgggagtttacgatagacttttcgacccaacaaagttatgtctcttcgttaaatagtatacggacagagatatcgacccctcttgaacatatatctcaggggaccacatcggtgtctgttattaaccacaccccaccgggcagttattttgctgtggatatacgagggcttgatgtctatcaggcgcgttttgaccatcttcgtctgattattgagcaaaataatttatatgtggccgggttcgttaatacggcaacaaatactttctaccgtttttcagattttacacatatatcagtgcccggtgtgacaacggtttccatgacaacggacagcagttataccactctgcaacgtgtcgcagcgctggaacgttccggaatgcaaatcagtcgtcactcactggtttcatcatatctggcgttaatggagttcagtggtaatacaatgaccagagatgcatccagagcagttctgcgttttgtcactgtcacagcagaagccttacgcttcaggcagatacagagagaatttcgtcaggcactgtctgaaactgctcctgtgtatacgatgacgccgggagacgtggacctcactctgaactgggggcgaatcagcaatgtgcttccggagtatcggggagaggatggtgtcagagtggggagaatatcctttaataatatatcagcgatactggggactgtggccgttatactgaattgccatcatcagggggcgcgttctgttcgcgccgtgaatgaagagagtcaaccagaatgtcagataactggcgacaggcctgttataaaaataaacaatacattatgggaaagtaatacagctgcagcgtttctgaacagaaagtcacagtttttatatacaacgggtaaataa

SEQ ID NO: 415 - DNA, 1133 bp, Ricinus communis, X52908
atggtccactagaggaggctatctcagcgctttattattacagtactggtggcactcagcttccaactctggctcgttcctttataatttgcatccaaatgatttcagaagcagcaagattccaatatattgagggagaaatgcgcacgagaattaggtacaaccggagatctgcaccagatcctagcgtaattacacttgagaatagttgggggagactttccactgcaattcaagagtctaaccaaggagcctttgctagtccaattcaactgcaaagacgtaatggttccaaattcagtgtgtacgatgtgagtatattaatccctatcatagctctcatggtgtatagatgcgcacctccaccatcgtcacagttttctttgcttataaggccagtggtaccaaattttaatgctgatgtttgtatggatcctgagcccatagtgcgtatcgtaggtcgaaatggtctatgtgttgatgttagggatggaagattccacaacggaaacgcaatacagttgtggccatgcaagtctaatacagatgcaaatcagctctggactttgaaaagagacaatactattcgatctaatggaaagtgtttaactacttacgggtacagtccgggagtctatgtgatgatctatgattgcaatactgctgcaactgatgccacccgctggcaaatatgggataatggaaccatcataaatcccagatctagtctagttttagcagcgacatcagggaacagtggtaccacacttacagtgcaaaccaacatttatgccgttagtcaaggttggcttcctactaataatacacaaccttttgtgacaaccattgttgggctatatggtctgtgcttgcaagcaaatagtggacaagtatggatagaggactgtagcagtgaaaaggctgaacaacagtgggctctttatgcagatggttcaatacgtcctcagcaaaaccgagataattgccttacaagtgattctaatatacgggaaacagttgtcaagatcctctcttgtggccctgcatcctctggccaacgatggatgttcaagaatgatggaaccattttaaatttgtatagtgggttggtgttagatgtgagggcatcggat

SEQ ID NO: 416 - DNA, 984 bp, Vibrio cholerae
cgggcagattctagacctcctgatgaaataaagcagtcaggtggtcttatgccaagaggacagagtgagtactttgaccgaggtactcaaatgaatatcaacctttatgatcatgcaagaggaactcagacgggatttgttaggcacgatgatggatatgtttccacctcaattagtttgagaagtgcccacttagtgggtcaaactatattgtctggtcattctacttattatatatatgttatagccactgcacccaacatgtttaacgttaatgatgtattaggggcatacagtcctcatccagatgaacaagaagtttctgctttaggtgggattccatactcccaaatatatggatggtatcgagttcattttggggtgcttgatgaacaattacatcgtaataggggctacagagatagatattacagtaacttagatattgctccagcagcagatggttatggattggcaggtttccctccggagcatagagcttggagggaagagccgtggattcatcatgcaccgccgggttgtgggaatgctccaagatcatcgatgagtaatacttgcgatgaaaaaacccaaagtctaggtgtaaaattccttgacgaataccaatctaaagttaaaagacaaatattttcaggctatcaatctgatattgatacacataatagaattaaggatgaattatgattaaattaaaatttggtgttttttttacagttttactatcttcagcatatgcacatggaacacctcaaaatattactgatttgtgtgcagaataccacaacacacaaatatatacgctaaatgataagatattttcgtatacagaatctctagctggaaaaagagagatggctatcattacttttaagaatggtgcaatttttcaagtagaagtaccaggtagtcaacatatagattcacaaaaaaaagcgattgaaaggatgaaggataccctgagga

SEQ ID NO: 417 - DNA, 236 bp, pBluescript II KS(+)
ctgcaggaattcgatatcaagcttatcgataccgtcgacctcgagggggggcccggtacccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgc

SEQ ID NO: 418 - DNA, 226 bp, pGEM-9Zf(-), X65312
gaatatgcatcactagtaagctttgctctagactggaattcgtcgacgagctccctatagtgagtcgtattagaggccgacttggccaaattcgtaatcatgtcatagctgtttcctgtgtgaaattgttatccgctcacaattccacacaacatacgagccggaagcataaagtgtaaagcctggggtgcctaatgagtgagctaactcacattaattgcgttgc

SEQ ID NO: 419 - DNA, 252 bp, pUC4KAN, X06404
agacagttttattgttcatgatgatatatttttatcttgtgcaatgtaacatcagagattttgagacacaacgtggctttcccccccccccctgcaggtcgacggatccggggaattcgtaatcatggtcatagctgtttcctgtgtgaaattgttatccgctcacaattccacacaacatacgagccggaagcataaagtgtaaagcctggggtgcctaatgagtgagctaactcacattaattgcgttgc

SEQ ID NO: 420 - DNA, 523 bp, Arabidopsis thaliana(4); identical to SEQ ID NO: 56

SEQ ID NO: 421 - DNA, 20 bp, Artificial Sequence
  Synthetic DNA
cgctgcacgatctgtatgat

SEQ ID NO: 422 - DNA, 21 bp, Artificial Sequence
  Synthetic DNA
tctcatatagcaaagcgcaca

SEQ ID NO: 423 - DNA, 23 bp, Artificial Sequence
  Synthetic DNA
tstacccytatgaagatgaaagc

SEQ ID NO: 424 - DNA, 23 bp, Artificial Sequence
  Synthetic DNA
ggataagctgtagtrctkggcat

SEQ ID NO: 425 - DNA, 20 bp, Artificial Sequence
  Synthetic DNA
actgtakcwgytttggytgt

SEQ ID NO: 426 - DNA, 21 bp, Artificial Sequence
  Synthetic DNA
ttattsytgggcwatgtakga

SEQ ID NO: 427 - DNA, 20 bp, Artificial Sequence
  Synthetic DNA
cacgaygtgaccacmgaccg

SEQ ID NO: 428 - DNA, 23 bp, Artificial Sequence
  Synthetic DNA
ttkggtctgttwggcatkgcytg

SEQ ID NO: 429 - DNA, 1234 bp, Artificial Sequence
  Synthetic DNA
  misc_feature (1)..(15): n is a, c, g, or t
  misc_feature (17)..(19): n is a, c, g, or t
  misc_feature (21)..(21): n is a, c, g, or t
  misc_feature (23)..(23): n is a, c, g, or t
  misc_feature (29)..(29): n is a, c, g, or t
  misc_feature (31)..(33): n is a, c, g, or t
  misc_feature (38)..(39): n is a, c, g, or t
  misc_feature (43)..(43): n is a, c, g, or t
  misc_feature (49)..(49): n is a, c, g, or t
  misc_feature (53)..(54): n is a, c, g, or t
  misc_feature (66)..(66): n is a, c, g, or t
  misc_feature (70)..(71): n is a, c, g, or t
  misc_feature (98)..(99): n is a, c, g, or t
  misc_feature (101)..(107): n is a, c, g, or t
  misc_feature (120)..(120): n is a, c, g, or t
  misc_feature (122)..(124): n is a, c, g, or t
  misc_feature (132)..(134): n is a, c, g, or t
  misc_feature (141)..(145): n is a, c, g, or t
  misc_feature (152)..(152): n is a, c, g, or t
  misc_feature (154)..(154): n is a, c, g, or t
  misc_feature (163)..(166): n is a, c, g, or t
  misc_feature (188)..(188): n is a, c, g, or t
  misc_feature (195)..(195): n is a, c, g, or t
  misc_feature (217)..(218): n is a, c, g, or t
  misc_feature (226)..(226): n is a, c, g, or t
  misc_feature (231)..(231): n is a, c, g, or t
  misc_feature (247)..(250): n is a, c, g, or t
  misc_feature (281)..(281): n is a, c, g, or t
  misc_feature (292)..(292): n is a, c, g, or t
  misc_feature (307)..(307): n is a, c, g, or t
  misc_feature (346)..(354): n is a, c, g, or t
  misc_feature (364)..(364): n is a, c, g, or t
  misc_feature (373)..(373): n is a, c, g, or t
  misc_feature (383)..(386): n is a, c, g, or t
  misc_feature (393)..(394): n is a, c, g, or t
  misc_feature (401)..(401): n is a, c, g, or t
  misc_feature (403)..(403): n is a, c, g, or t
  misc_feature (408)..(408): n is a, c, g, or t
  misc_feature (412)..(412): n is a, c, g, or t
  misc_feature (426)..(426): n is a, c, g, or t
  misc_feature (441)..(441): n is a, c, g, or t
  misc_feature (453)..(453): n is a, c, g, or t
  misc_feature (457)..(457): n is a, c, g, or t
  misc_feature (460)..(463): n is a, c, g, or t
  misc_feature (474)..(474): n is a, c, g, or t
  misc_feature (483)..(483): n is a, c, g, or t
  misc_feature (518)..(518): n is a, c, g, or t
  misc_feature (526)..(526): n is a, c, g, or t
  misc_feature (559)..(569): n is a, c, g, or t
  misc_feature (571)..(573): n is a, c, g, or t
  misc_feature (580)..(581): n is a, c, g, or t
  misc_feature (584)..(584): n is a, c, g, or t
  misc_feature (590)..(591): n is a, c, g, or t
  misc_feature (593)..(594): n is a, c, g, or t
  misc_feature (597)..(598): n is a, c, g, or t
  misc_feature (600)..(601): n is a, c, g, or t
  misc_feature (604)..(604): n is a, c, g, or t
  misc_feature (620)..(627): n is a, c, g, or t
  misc_feature (630)..(630): n is a, c, g, or t
  misc_feature (632)..(632): n is a, c, g, or t
  misc_feature (668)..(668): n is a, c, g, or t
  misc_feature (681)..(681): n is a, c, g, or t
  misc_feature (730)..(730): n is a, c, g, or t
  misc_feature (736)..(736): n is a, c, g, or t
  misc_feature (750)..(750): n is a, c, g, or t
  misc_feature (769)..(776): n is a, c, g, or t
  misc_feature (778)..(779): n is a, c, g, or t
  misc_feature (781)..(782): n is a, c, g, or t
  misc_feature (787)..(787): n is a, c, g, or t
  misc_feature (806)..(806): n is a, c, g, or t
  misc_feature (808)..(808): n is a, c, g, or t
  misc_feature (810)..(810): n is a, c, g, or t
  misc_feature (816)..(816): n is a, c, g, or t
  misc_feature (826)..(826): n is a, c, g, or t
  misc_feature (870)..(870): n is a, c, g, or t
  misc_feature (876)..(877): n is a, c, g, or t
  misc_feature (880)..(880): n is a, c, g, or t
  misc_feature (897)..(898): n is a, c, g, or t
  misc_feature (900)..(900): n is a, c, g, or t
  misc_feature (902)..(902): n is a, c, g, or t
  misc_feature (904)..(904): n is a, c, g, or t
  misc_feature (918)..(919): n is a, c, g, or t
  misc_feature (921)..(922): n is a, c, g, or t
  misc_feature (930)..(931): n is a, c, g, or t
  misc_feature (938)..(938): n is a, c, g, or t
  misc_feature (940)..(940): n is a, c, g, or t
  misc_feature (947)..(947): n is a, c, g, or t
  misc_feature (955)..(955): n is a, c, g, or t
  misc_feature (1011)..(1011): n is a, c, g, or t
  misc_feature (1013)..(1014): n is a, c, g, or t
  misc_feature (1021)..(1021): n is a, c, g, or t
  misc_feature (1031)..(1031): n is a, c, g, or t
  misc_feature (1034)..(1034): n is a, c, g, or t
  misc_feature (1046)..(1046): n is a, c, g, or t
  misc_feature (1068)..(1068): n is a, c, g, or t
  misc_feature (1070)..(1071): n is a, c, g, or t
  misc_feature (1074)..(1074): n is a, c, g, or t
  misc_feature (1080)..(1080): n is a, c, g, or t
  misc_feature (1082)..(1082): n is a, c, g, or t
  misc_feature (1084)..(1086): n is a, c, g, or t
  misc_feature (1091)..(1091): n is a, c, g, or t
  misc_feature (1097)..(1097): n is a, c, g, or t
  misc_feature (1115)..(1115): n is a, c, g, or t
  misc_feature (1130)..(1130): n is a, c, g, or t
  misc_feature (1137)..(1137): n is a, c, g, or t
  misc_feature (1145)..(1145): n is a, c, g, or t
  misc_feature (1216)..(1216): n is a, c, g, or t
  misc_feature (1222)..(1222): n is a, c, g, or t
  misc_feature (1228)..(1229): n is a, c, g, or t
  misc_feature (1231)..(1234): n is a, c, g, or t
nnnnnnnnnnnnnnncnnncncngaccgngnnnttcannaacnctcccntcgnnctcttcagatgnattnnaagaaaagcccctgggggtgttgtccnnannnnnnngccgaccctgtcncnnnaagaatgnnnaaattannnnnaagctgngngagggggtnnnncttgacgactcgggaaaactcnttgcaancacagtaaacaaggccattgcnnctctcagnttttnccaacaacaccatttnnnnttaacatggatacccctttatacaccaaagntggaaaactanccttacaagtttctnccaccattaagtatattaaaatcaacaattttgaatacnnnnnnnnnagcttttggntcaggtttnggactcagtnnnngcgcccnngcagtananttagnctcnccacttacatttgntgataaagggaatanaaagattacccnaaanagnnnnttgcatgttanaacaggagntgcaattgaaagcaacatcagttgggctaaaggtntaaaattngaagatggtgccatagctacaaacattggtaannnnnnnnnnntnnnaaccagnngtncagaannannagnnannaangcttatccaatccaannnnnnnntgncnctggtctcagctttgacagcacaggagccataatgnctggcaataaagnctatgataaattaactttgtggacaacgcctgacccatcaccaaactgncaaatncttgcagaaaatgntgcaaaactaacactttgnnnnnnnnanngnnacagncaaatactggccactgtancngntttggntgttagaagnggaaacttaaacccaattactggcacagtaagcagtgctcaagnttttcnncgntttgatgcaaatggtgnncntntnacagaacactctanncnnaaaaaatnntggggcnanaagcaangagatagnatagatggcactccatacaccaatgctgttggttttatgccaaattcaacagcttntnnaaagacncaaagttctnctnctaaaaataatntagtgggtcaagtatacatgantnnagntgtttnanannncatgnttcttnctataactcttaatggtnctgatgacaccaccngtgcatnctcaatgncattttcatacacctggactaacggaagctatatcggagcaacatttggagctaactcatacaccttctcntacatngcccannannnn

SEQ ID NO: 430 - DNA, 1215 bp, Artificial Sequence
  Synthetic DNA
  misc_feature (2)..(4): n is a, c, g, or t
  misc_feature (6)..(6): n is a, c, g, or t
  misc_feature (8)..(8): n is a, c, g, or t
  misc_feature (14)..(14): n is a, c, g, or t
  misc_feature (16)..(18): n is a, c, g, or t
  misc_feature (23)..(24): n is a, c, g, or t
  misc_feature (28)..(28): n is a, c, g, or t
  misc_feature (34)..(34): n is a, c, g, or t
  misc_feature (38)..(39): n is a, c, g, or t
  misc_feature (51)..(51): n is a, c, g, or t
  misc_feature (55)..(56): n is a, c, g, or t
  misc_feature (83)..(84): n is a, c, g, or t
  misc_feature (86)..(92): n is a, c, g, or t
  misc_feature (105)..(105): n is a, c, g, or t
  misc_feature (107)..(109): n is a, c, g, or t
  misc_feature (117)..(119): n is a, c, g, or t
  misc_feature (126)..(130): n is a, c, g, or t
  misc_feature (137)..(137): n is a, c, g, or t
  misc_feature (139)..(139): n is a, c, g, or t
  misc_feature (148)..(151): n is a, c, g, or t
  misc_feature (173)..(173): n is a, c, g, or t
  misc_feature (180)..(180): n is a, c, g, or t
  misc_feature (202)..(203): n is a, c, g, or t
  misc_feature (211)..(211): n is a, c, g, or t
  misc_feature (216)..(216): n is a, c, g, or t
  misc_feature (232)..(235): n is a, c, g, or t
  misc_feature (266)..(266): n is a, c, g, or t
  misc_feature (277)..(277): n is a, c, g, or t
  misc_feature (292)..(292): n is a, c, g, or t
  misc_feature (331)..(339): n is a, c, g, or t
  misc_feature (349)..(349): n is a, c, g, or t
  misc_feature (358)..(358): n is a, c, g, or t
  misc_feature (368)..(371): n is a, c, g, or t
  misc_feature (378)..(379): n is a, c, g, or t
  misc_feature (386)..(386): n is a, c, g, or t
  misc_feature (388)..(388): n is a, c, g, or t
  misc_feature (393)..(393): n is a, c, g, or t
  misc_feature (397)..(397): n is a, c, g, or t
  misc_feature (411)..(411): n is a, c, g, or t
  misc_feature (426)..(426): n is a, c, g, or t
  misc_feature (438)..(438): n is a, c, g, or t
  misc_feature (442)..(442): n is a, c, g, or t
  misc_feature (445)..(448): n is a, c, g, or t
  misc_feature (459)..(459): n is a, c, g, or t
  misc_feature (468)..(468): n is a, c, g, or t
  misc_feature (503)..(503): n is a, c, g, or t
  misc_feature (511)..(511): n is a, c, g, or t
  misc_feature (544)..(554): n is a, c, g, or t
  misc_feature (556)..(558): n is a, c, g, or t
  misc_feature (565)..(566): n is a, c, g, or t
  misc_feature (569)..(569): n is a, c, g, or t
  misc_feature (575)..(576): n is a, c, g, or t
  misc_feature (578)..(579): n is a, c, g, or t
  misc_feature (582)..(583): n is a, c, g, or t
  misc_feature (585)..(586): n is a, c, g, or t
  misc_feature (589)..(589): n is a, c, g, or t
  misc_feature (605)..(612): n is a, c, g, or t
  misc_feature (615)..(615): n is a, c, g, or t
  misc_feature (617)..(617): n is a, c, g, or t
  misc_feature (653)..(653): n is a, c, g, or t
  misc_feature (666)..(666): n is a, c, g, or t
  misc_feature (715)..(715): n is a, c, g, or t
  misc_feature (721)..(721): n is a, c, g, or t
  misc_feature (735)..(735): n is a, c, g, or t
  misc_feature (754)..(761): n is a, c, g, or t
  misc_feature (763)..(764): n is a, c, g, or t
  misc_feature (766)..(767): n is a, c, g, or t
  misc_feature (772)..(772): n is a, c, g, or t
  misc_feature (791)..(791): n is a, c, g, or t
  misc_feature (793)..(793): n is a, c, g, or t
  misc_feature (795)..(795): n is a, c, g, or t
  misc_feature (801)..(801): n is a, c, g, or t
  misc_feature (811)..(811): n is a, c, g, or t
  misc_feature (855)..(855): n is a, c, g, or t
  misc_feature (861)..(862): n is a, c, g, or t
  misc_feature (865)..(865): n is a, c, g, or t
  misc_feature (882)..(883): n is a, c, g, or t
  misc_feature (885)..(885): n is a, c, g, or t
  misc_feature (887)..(887): n is a, c, g, or t
  misc_feature (889)..(889): n is a, c, g, or t
  misc_feature (903)..(904): n is a, c, g, or t
  misc_feature (906)..(907): n is a, c, g, or t
  misc_feature (915)..(916): n is a, c, g, or t
  misc_feature (923)..(923): n is a, c, g, or t
  misc_feature (925)..(925): n is a, c, g, or t
  misc_feature (932)..(932): n is a, c, g, or t
  misc_feature (940)..(940): n is a, c, g, or t
  misc_feature (996)..(996): n is a, c, g, or t
  misc_feature (998)..(999): n is a, c, g, or t
  misc_feature (1006)..(1006): n is a, c, g, or t
  misc_feature (1016)..(1016): n is a, c, g, or t
  misc_feature (1019)..(1019): n is a, c, g, or t
  misc_feature (1031)..(1031): n is a, c, g, or t
  misc_feature (1053)..(1053): n is a, c, g, or t
  misc_feature (1055)..(1056): n is a, c, g, or t
  misc_feature (1059)..(1059): n is a, c, g, or t
  misc_feature (1065)..(1065): n is a, c, g, or t
  misc_feature (1067)..(1067): n is a, c, g, or t
  misc_feature (1069)..(1071): n is a, c, g, or t
  misc_feature (1076)..(1076): n is a, c, g, or t
  misc_feature (1082)..(1082): n is a, c, g, or t
  misc_feature (1100)..(1100): n is a, c, g, or t
  misc_feature (1115)..(1115): n is a, c, g, or t
  misc_feature (1122)..(1122): n is a, c, g, or t
  misc_feature (1130)..(1130): n is a, c, g, or t
  misc_feature (1201)..(1201): n is a, c, g, or t
  misc_feature (1207)..(1207): n is a, c, g, or t
  misc_feature (1213)..(1214): n is a, c, g, or t
cnnncncngaccgngnnnttcannaacnctcccntcgnnctcttcagatgnattnnaagaaaagcccctgggggtgttgtccnnannnnnnngccgaccctgtcncnnnaagaatgnnnaaattannnnnaagctgngngagggggtnnnncttgacgactcgggaaaactcnttgcaancacagtaaacaaggccattgcnnctctcagnttttnccaacaacaccatttnnnnttaacatggatacccctttatacaccaaagntggaaaactanccttacaagtttctnccaccattaagtatattaaaatcaacaattttgaatacnnnnnnnnnagcttttggntcaggtttnggactcagtnnnngcgcccnngcagtananttagnctcnccacttacatttgntgataaagggaatanaaagattacccnaaanagnnnnttgcatgttanaacaggagntgcaattgaaagcaacatcagttgggctaaaggtntaaaattngaagatggtgccatagctacaaacattggtaannnnnnnnnnntnnnaaccagnngtncagaannannagnnannaangcttatccaatccaannnnnnnntgncnctggtctcagctttgacagcacaggagccataatgnctggcaataaagnctatgataaattaactttgtggacaacgcctgacccatcaccaaactgncaaatncttgcagaaaatgntgcaaaactaacactttgnnnnnnnnanngnnacagncaaatactggccactgtancngntttggntgttagaagnggaaacttaaacccaattactggcacagtaagcagtgctcaagnttttcnncgntttgatgcaaatggtgnncntntnacagaacactctanncnnaaaaaatnntggggcnanaagcaangagatagnatagatggcactccatacaccaatgctgttggttttatgccaaattcaacagcttntnnaaagacncaaagttctnctnctaaaaataatntagtgggtcaagtatacatgantnnagntgtttnanannncatgnttcttnctataactcttaatggtnctgatgacaccaccngtgcatnctcaatgncattttcatacacctggactaacggaagctatatcggagcaacatttggagctaactcatacaccttctcntacatngcccanna

SEQ ID NO: 431 - DNA, 13 bp, Artificial Sequence
  Synthetic DNA
agcaaaaagcagg

SEQ ID NO: 432 - DNA, 12 bp, Artificial Sequence
  Synthetic DNA
agtagaaacaag

SEQ ID NO: 433 - DNA, 28 bp, Artificial Sequence
  Synthetic DNA
tattcgtctcagggagcaaaagcagggg

SEQ ID NO: 434 - DNA, 35 bp, Artificial Sequence
  Synthetic DNA
atatcgtctcgtattagtagaaacaagggtgtttt

SEQ ID NO: 435 - DNA, 29 bp, Artificial Sequence
  Synthetic DNA
tattggtctcagggagcaaaagcaggagt

SEQ ID NO: 436 - DNA, 36 bp, Artificial Sequence
  Synthetic DNA
atatggtctcgtattagtagaaacaaggagtttttt

SEQ ID NO: 437 - DNA, 29 bp, Artificial Sequence
  Synthetic DNA
tattcgtctcagggagcaaaagcaggtag

SEQ ID NO: 438 - DNA, 36 bp, Artificial Sequence
  Synthetic DNA
atatcgtctcgtattagtagaaacaaggtagttttt

SEQ ID NO: 439 - DNA, 23 bp, Artificial Sequence
  Synthetic DNA
tgacagtgacacactctgtcaac

SEQ ID NO: 440 - DNA, 24 bp, Artificial Sequence
  Synthetic DNA
aatcacgaatgaccaaattgaagt

SEQ ID NO: 441 - DNA, 52 bp, Artificial Sequence
  Synthetic DNA
aggcaatagatggagtcaccaataagaatggttgtttcgaattctatcacaa

SEQ ID NO: 442 - DNA, 22 bp, Artificial Sequence
  Synthetic DNA
ttaaaatgaatccaaatcagaa

SEQ ID NO: 443 - DNA, 22 bp, Artificial Sequence
  Synthetic DNA
gcaggagtgaagatgaatccaa

SEQ ID NO: 444 - DNA, 20 bp, Artificial Sequence
  Synthetic DNA
agcaaaagcaggtagatrtt

SEQ ID NO: 445 - DNA, 22 bp, Artificial Sequence
  Synthetic DNA
gctttcctataatgcacgacag

SEQ ID NO: 446 - DNA, 25 bp, Artificial Sequence
  Synthetic DNA
aacaatgctaccttcaactatacaa

SEQ ID NO: 447 - DNA, 22 bp, Artificial Sequence
  Synthetic DNA
ggagacacaattgcctacctgc

SEQ ID NO: 448 - DNA, 20 bp, Artificial Sequence
  Synthetic DNA
cacgacgtgaccacagaccg

SEQ ID NO: 449 - DNA, 24 bp, Artificial Sequence
  Synthetic DNA
gacggagccagcattaagtttgat

SEQ ID NO: 450 - DNA, 22 bp, Artificial Sequence
  Synthetic DNA
tattcagcatcacctcctttcc

SEQ ID NO: 451 - DNA, 24 bp, Artificial Sequence
  Synthetic DNA
cctaaaatggcgcctgctatcctg

SEQ ID NO: 452 - DNA, 23 bp, Artificial Sequence
  Synthetic DNA
gagccttgggtccggtttctatg

SEQ ID NO: 453 - DNA, 20 bp, Artificial Sequence
  Synthetic DNA
cacgatgtgaccaccgaccg

SEQ ID NO: 454 - DNA, 20 bp, Artificial Sequence
  Synthetic DNA
caaggactaccaggccgtca

SEQ ID NO: 455 - DNA, 21 bp, Artificial Sequence
  Synthetic DNA
gccgccaccactcctaactat

SEQ ID NO: 456 - DNA, 20 bp, Artificial Sequence
  Synthetic DNA
tccctacgatgcagacaacg

SEQ ID NO: 457 - DNA, 20 bp, Artificial Sequence
  Synthetic DNA
actgtatcagttttggttgt

SEQ ID NO: 458 - DNA, 22 bp, Artificial Sequence
  Synthetic DNA
acgttttgatgacgcgactatg

SEQ ID NO: 459 - DNA, 23 bp, Artificial Sequence
  Synthetic DNA
cgccgcggtcagatctacacttt

SEQ ID NO: 460 - DNA, 20 bp, Artificial Sequence
  Synthetic DNA
cgctgcacgatttgtatgat

SEQ ID NO: 461 - DNA, 16 bp, Artificial Sequence
  Synthetic DNA
cacgatgtgaccaccg

SEQ ID NO: 462 - DNA, 24 bp, Artificial Sequence
  Synthetic DNA
cttcttccccatggctcacaacac

SEQ ID NO: 463 - DNA, 23 bp, Artificial Sequence
  Synthetic DNA
tctacccctatgaagatgaaagc

SEQ ID NO: 464 - DNA, 20 bp, Artificial Sequence
  Synthetic DNA
ctccgcgccgcaagtcagtt

SEQ ID NO: 465 - DNA, 20 bp, Artificial Sequence
  Synthetic DNA
cgctgcacgatctgtatgat

SEQ ID NO: 466 - DNA, 27 bp, Artificial Sequence
  Synthetic DNA
atttctggagatgtcccgtaggagaac

SEQ ID NO: 467 - DNA, 21 bp, Artificial Sequence
  Synthetic DNA
ctcgaggttgtcaggatatag

SEQ ID NO: 468 - DNA, 21 bp, Artificial Sequence
  Synthetic DNA
agaggtcaataccaacaacta

SEQ ID NO: 469 - DNA, 16 bp, Artificial Sequence
  Synthetic DNA
gcacttctgtttcccc

SEQ ID NO: 470 - DNA, 19 bp, Artificial Sequence
  Synthetic DNA
atcacagatctyagcaaat

SEQ ID NO: 471 - DNA, 26 bp, Artificial Sequence
  Synthetic DNA
gctcttagcaaagtcaagttgaatga

SEQ ID NO: 472 - DNA, 26 bp, Artificial Sequence
  Synthetic DNA
gatggctcttagcaaagtcaagttaa

SEQ ID NO: 473 - DNA, 25 bp, Artificial Sequence
  Synthetic DNA
ttgtgttggctctcttggcgttctt

SEQ ID NO: 474 - DNA, 21 bp, Artificial Sequence
  Synthetic DNA
tcagcgatctctccaccaaag

SEQ ID NO: 475 - DNA, 21 bp, Artificial Sequence
  Synthetic DNA
ggcagttctgggtgaagtcaa

SEQ ID NO: 476 - DNA, 20 bp, Artificial Sequence
  Synthetic DNA
tggccccattaaaaatgtgt

SEQ ID NO: 477 - DNA, 20 bp, Artificial Sequence
  Synthetic DNA
ggcttatgtggccccttact

SEQ ID NO: 478 - DNA, 21 bp, Artificial Sequence
  Synthetic DNA
acgcaatctagcagatgaagc

SEQ ID NO: 479 - DNA, 22 bp, Artificial Sequence
  Synthetic DNA
agcgatagctttctccaagtgg

SEQ ID NO: 480 - DNA, 24 bp, Artificial Sequence
  Synthetic DNA
aggctcaggtcaatctggcgtgga

SEQ ID NO: 481 - DNA, 19 bp, Artificial Sequence
  Synthetic DNA
gctgcggtaggtggttcaa

SEQ ID NO: 482 - DNA, 25 bp, Artificial Sequence
  Synthetic DNA
gctggcgccgctggcaacaaaattc

SEQ ID NO: 483 - DNA, 22 bp, Artificial Sequence
  Synthetic DNA
cagccctccaacgcgccatccc

SEQ ID NO: 484 - DNA, 18 bp, Artificial Sequence
  Synthetic DNA
cccgaaaacatccgcagg

SEQ ID NO: 485 - DNA, 16 bp, Artificial Sequence
  Synthetic DNA
tccgcattgctcagcc

SEQ ID NO: 486 - DNA, 21 bp, Artificial Sequence
  Synthetic DNA
cagattacgaaacggcattac

SEQ ID NO: 487 - DNA, 20 bp, Artificial Sequence
  Synthetic DNA
cgttggtttattcggagtta

SEQ ID NO: 488 - DNA, 20 bp, Artificial Sequence
  Synthetic DNA
gtcaacatgcagctacagga

SEQ ID NO: 489 - DNA, 21 bp, Artificial Sequence
  Synthetic DNA
agtatcattaatcactagtgc

SEQ ID NO: 490 - DNA, 23 bp, Artificial Sequence
  Synthetic DNA
gtaaacagttgacgatattctcg

SEQ ID NO: 491 - DNA, 20 bp, Artificial Sequence
  Synthetic DNA
gctatagagattgatgaagg

SEQ ID NO: 492 - DNA, 21 bp, Artificial Sequence
  Synthetic DNA
ccaccaacagtagaaaatgcc

SEQ ID NO: 493 - DNA, 25 bp, Artificial Sequence
  Synthetic DNA
atcctagtgatccattagaaacgac

SEQ ID NO: 494 - DNA, 19 bp, Artificial Sequence
  Synthetic DNA
ctgaccaatctaagcctgc

SEQ ID NO: 495 - DNA, 18 bp, Artificial Sequence
  Synthetic DNA
taaatcattgactgctaa

SEQ ID NO: 496 - DNA, 28 bp, Artificial Sequence
  Synthetic DNA
gcttccagattatgtgatagcaagacta

SEQ ID NO: 497 - DNA, 22 bp, Artificial Sequence
  Synthetic DNA
atcggaacttttctttctcatt

SEQ ID NO: 498 - DNA, 20 bp, Artificial Sequence
  Synthetic DNA
accggggatcctaggcattt

SEQ ID NO: 499 - DNA, 27 bp, Artificial Sequence
  Synthetic DNA
gctgtatcatcatttaataaactgctg

SEQ ID NO: 500 - DNA, 27 bp, Artificial Sequence
  Synthetic DNA
aacaatggcacctagtaatatttctgg

SEQ ID NO: 501 - DNA, 22 bp, Artificial Sequence
  Synthetic DNA
ggataacgttgcagcagcttcg

SEQ ID NO: 502 - DNA, 21 bp, Artificial Sequence
  Synthetic DNA
cagttccgttatcgccattgc

SEQ ID NO: 503 - DNA, 20 bp, Artificial Sequence
  Synthetic DNA
tcaaatcctcgttgacagac

SEQ ID NO: 504 - DNA, 20 bp, Artificial Sequence
  Synthetic DNA
caacatgggaagctgttttg

SEQ ID NO: 505 - DNA, 24 bp, Artificial Sequence
  Synthetic DNA
ctattagatttccatttgcctcaa

SEQ ID NO: 506 - DNA, 22 bp, Artificial Sequence
  Synthetic DNA
ttggagtgatgcattcagaatt

SEQ ID NO: 507 - DNA, 26 bp, Artificial Sequence
  Synthetic DNA
ccataaagatagaccagctaccatga

SEQ ID NO: 508 - DNA, 24 bp, Artificial Sequence
  Synthetic DNA
agatagaccagctaccatgattgc

SEQ ID NO: 509 - DNA, 18 bp, Artificial Sequence
  Synthetic DNA
atyctgctcccactagtc

SEQ ID NO: 510 - DNA, 23 bp, Artificial Sequence
  Synthetic DNA
tgcgaaagcttatataggcatga

SEQ ID NO: 511 - DNA, 21 bp, Artificial Sequence
  Synthetic DNA
ttccgtagaaggccctctttt

SEQ ID NO: 512 - DNA, 24 bp, Artificial Sequence
  Synthetic DNA
catgttcycctgtgtagtaaggct

SEQ ID NO: 513 - DNA, 22 bp, Artificial Sequence
  Synthetic DNA
ctctacaggcacattctatggt

SEQ ID NO: 514 - DNA, 25 bp, Artificial Sequence
  Synthetic DNA
tctgctatttcaaatgcttcatgaa

SEQ ID NO: 515 - DNA, 21 bp, Artificial Sequence
  Synthetic DNA
ttaggcctgttgggcatagat

SEQ ID NO: 516 - DNA, 24 bp, Artificial Sequence
  Synthetic DNA
gttggcgggtatagggtagagcat

SEQ ID NO: 517 - DNA, 20 bp, Artificial Sequence
  Synthetic DNA
aagctatgtggtggtggggc

SEQ ID NO: 518 - DNA, 21 bp, Artificial Sequence
  Synthetic DNA
gcgacgcccaccaactctcac

SEQ ID NO: 519 - DNA, 21 bp, Artificial Sequence
  Synthetic DNA
ccattttaggacggcgggtag

SEQ ID NO: 520 - DNA, 23 bp, Artificial Sequence
  Synthetic DNA
ttgggtctgttaggcatggcctg

SEQ ID NO: 521 - DNA, 18 bp, Artificial Sequence
  Synthetic DNA
gggcgaactgcaccagac

SEQ ID NO: 522 - DNA, 22 bp, Artificial Sequence
  Synthetic DNA
cctggtaagtgtctgtcaatcc

SEQ ID NO: 523 - DNA, 21 bp, Artificial Sequence
  Synthetic DNA
agtgccatctatgctatctcc

SEQ ID NO: 524 - DNA, 19 bp, Artificial Sequence
  Synthetic DNA
ttattgttgggctatgtag

SEQ ID NO: 525 - DNA, 19 bp, Artificial Sequence
  Synthetic DNA
atcgcctgctcgtcctcat

SEQ ID NO: 526 - DNA, 25 bp, Artificial Sequence
  Synthetic DNA
ttccgggtacacaagtccaaaggtt

SEQ ID NO: 527 - DNA, 22 bp, Artificial Sequence
  Synthetic DNA
ttaggcatggcttgttgaccca

SEQ ID NO: 528 - DNA, 24 bp, Artificial Sequence
  Synthetic DNA
tcatcaaccacctgcctgctcata

SEQ ID NO: 529 - DNA, 23 bp, Artificial Sequence
  Synthetic DNA
ggataggcagttgtgctgggcat

SEQ ID NO: 530 - DNA, 23 bp, Artificial Sequence
  Synthetic DNA
cctccggcccgtctacctctaaa

SEQ ID NO: 531 - DNA, 21 bp, Artificial Sequence
  Synthetic DNA
tctcatatagcaaagcgcaca

SEQ ID NO: 532 - DNA, 28 bp, Artificial Sequence
  Synthetic DNA
cacatccttgagtgattaagtttgatga

SEQ ID NO: 533 - DNA, 21 bp, Artificial Sequence
  Synthetic DNA
ctttgggagttgaacacagtt

SEQ ID NO: 534 - DNA, 20 bp, Artificial Sequence
  Synthetic DNA
tagcagtattgaagttggca

SEQ ID NO: 535 - DNA, 16 bp, Artificial Sequence
  Synthetic DNA
cggacacccaaagtag

SEQ ID NO: 536 - DNA, 19 bp, Artificial Sequence
  Synthetic DNA
ctattgaytgattrtcacc

SEQ ID NO: 537 - DNA, 21 bp, Artificial Sequence
  Synthetic DNA
tgctccgttggatggtgtatt

SEQ ID NO: 538 - DNA, 30 bp, Artificial Sequence
  Synthetic DNA
tgtcaatattatctcctgtactacgttgaa

SEQ ID NO: 539 - DNA, 25 bp, Artificial Sequence
  Synthetic DNA
cagccgacagcactgggcattcata

SEQ ID NO: 540 - DNA, 21 bp, Artificial Sequence
  Synthetic DNA
gggtcagcacgtttgtcattg

SEQ ID NO: 541 - DNA, 21 bp, Artificial Sequence
  Synthetic DNA
ctccgattgtgattgcttcgt

SEQ ID NO: 542 - DNA, 20 bp, Artificial Sequence
  Synthetic DNA
cctgaacacctgaagccaat

SEQ ID NO: 543 - DNA, 20 bp, Artificial Sequence
  Synthetic DNA
ggcaaatctgcccaagaata

SEQ ID NO: 544 - DNA, 21 bp, Artificial Sequence
  Synthetic DNA
tgtttggttggttattcgtgc

SEQ ID NO: 545 - DNA, 23 bp, Artificial Sequence
  Synthetic DNA
cttagccaacaaatcgtttaccg

SEQ ID NO: 546 - DNA, 25 bp, Artificial Sequence
  Synthetic DNA
ggatcaaacagatcggtgactgggt

SEQ ID NO: 547 - DNA, 20 bp, Artificial Sequence
  Synthetic DNA
ttgtcgcggatttgcaacta

SEQ ID NO: 548 - DNA, 24 bp, Artificial Sequence
  Synthetic DNA
cttctgcagattgcggcgtgccgt

SEQ ID NO: 549 - DNA, 20 bp, Artificial Sequence
  Synthetic DNA
attgcccgagtgcaacgcat

SEQ ID NO: 550 - DNA, 19 bp, Artificial Sequence
  Synthetic DNA
cgccatgcaagcgcctatc

SEQ ID NO: 551 - DNA, 25 bp, Artificial Sequence
  Synthetic DNA
aaacaatttgcatgaagtctgagaa

SEQ ID NO: 552 - DNA, 20 bp, Artificial Sequence
  Synthetic DNA
tgctgcataacctaggtgtg

SEQ ID NO: 553 - DNA, 21 bp, Artificial Sequence
  Synthetic DNA
ccaagagaaagaggtgtctgt

SEQ ID NO: 554 - DNA, 20 bp, Artificial Sequence
  Synthetic DNA
aataccaacatcagccatca

SEQ ID NO: 555 - DNA, 21 bp, Artificial Sequence
  Synthetic DNA
ttcttctggtactaaaagtgg

SEQ ID NO: 556 - DNA, 20 bp, Artificial Sequence
  Synthetic DNA
cgtaccttggatattcaccg

SEQ ID NO: 557 - DNA, 23 bp, Artificial Sequence
  Synthetic DNA
ctaatattgtagggaatattacc

SEQ ID NO: 558 - DNA, 23 bp, Artificial Sequence
  Synthetic DNA
aaatttcaccagtttctggatct

SEQ ID NO: 559 - DNA, 27 bp, Artificial Sequence
  Synthetic DNA
cttctctatgagcctccttaactactg

SEQ ID NO: 560 - DNA, 19 bp, Artificial Sequence
  Synthetic DNA
tcgtttctccaatcgcaat

SEQ ID NO: 561 - DNA, 23 bp, Artificial Sequence
  Synthetic DNA
gtagatggttcattatcattgtg

SEQ ID NO: 562 - DNA, 24 bp, Artificial Sequence
  Synthetic DNA
tccggatactccgtatcctattcc

SEQ ID NO: 563 - DNA, 30 bp, Artificial Sequence
  Synthetic DNA
atgtggtggattataataatcactgacatg

SEQ ID NO: 564 - DNA, 29 bp, Artificial Sequence
  Synthetic DNA
atataatgatgactgttgttctttgtgca

SEQ ID NO: 565 - DNA, 24 bp, Artificial Sequence
  Synthetic DNA
ttgggaagcttgtatcatggcact

SEQ ID NO: 566 - DNA, 23 bp, Artificial Sequence
  Synthetic DNA
ccaccaaagaaccatgttaaacc

SEQ ID NO: 567 - DNA, 20 bp, Artificial Sequence
  Synthetic DNA
ccttcgccaccttcacctgc

SEQ ID NO: 568 - DNA, 23 bp, Artificial Sequence
  Synthetic DNA
tattggttagatacggttacggt

SEQ ID NO: 569 - DNA, 20 bp, Artificial Sequence
  Synthetic DNA
ctgttgcctccattgacaga

SEQ ID NO: 570 - DNA, 20 bp, Artificial Sequence
  Synthetic DNA
caagcacacgttatttcccc

SEQ ID NO: 571 - DNA, 21 bp, Artificial Sequence
  Synthetic DNA
amaccgaggtcgaaacgtayg

SEQ ID NO: 572 - DNA, 22 bp, Artificial Sequence
  Synthetic DNA
cactgttggttcggtgggaaag

SEQ ID NO: 573 - DNA, 26 bp, Artificial Sequence
  Synthetic DNA
  misc_feature (18)..(26): n is a, c, g, or t
gtttcccagtcacgatcnnnnnnnnn

SEQ ID NO: 574 - DNA, 17 bp, Artificial Sequence
  Synthetic DNA
gtttcccagtcacgatc

SEQ ID NO: 575 - DNA, 35345 bp, ATCC#VR-3, strain GB
ctatctatataatataccttatagatggaatggtgccaacatgtaaatgaggtaatttaaaaaagtgcgcgctgtgtggtgattggctgcggggttaacggctaaaaggggcggcgcgaccgtgggaaaatgacgtgacttatgtgggaggagttatgttgcaagttattacggtaaatgtgacgtaaaacgaggtgtggtttgaacacggaagtagacagttttcccacgcttactgacaggatatgaggtagttttgggcggatgcaagtgaaaattctccattttcgcgcgaaaactaaatgaggaagtgaatttctgagtcatttcgcggttatgccagggtggagtatttgccgagggccgagtagactttgaccgtttacgtggaggtttcgattaccgtgtttttcacctaaatttccgcgtacggtgtcaaagttctgtgtttttacgtaggtgtcagctgatcgctagggtatttaaacctgacgagttccgtcaagaggccactcttgagtgccagcgagaagagttttctcctccgcgccgcaagtcagttctgcgctttgaaaatgagacacctgcgcttcctgccacaggaggttatctccagtgagaccgggatcgaaatactggagtttgtggtaaataccctaatgggagacgacccggaaccgccagtgcagcctttcgatccacctacgctgcacgatctgtatgatttagagatagacgggccggaggatcccaatgaggaagctgtgaatgggttttttactgattctatgctgctagctgctgatgaaggattggacataaaccctcctcctgagacacttgttaccccaggggtggttgtggaaagcggcataggtgggaaaaaattgcctgatctgggagcagctgaaatggacttgcgttgttatgaagagggttttcctcccagtgatgatgaagatggggaaactgagcagtccatccataccgcagtaaatgagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccactttatttacagtaagtgtatttaagtgaaatttaaaggaatagtgtagctatttaataactgttgaatggtagatttatgtttttttcttgcgattttttgtaggtcctgtgtctgatgatgagtcaccttctcctgattcaactacctcacctcctgaaattcaggcgcccgcacctgcaaacgtatgcaagcccattcctgtgaagcctaagcctgggaaacgccctgctgtggataagcttgaggacttgttggagggtggggatggacctttggaccttagtacccggaaactgccaaggcaatgagtgccctgcagctgtgtttatttaatgtgacgtcatgtaataaaattatgtcagctgctgagtgttttattacttcttgggtggggacttggatatataagtaggagcagatctgtgtggttagctcacagcaacctgctgccatccatggaggtttgggctatcttggaagacctcagacagactaagctactgctagaaaacgcctcggacggagtctctggcctttggagattctggttcggtggtgatctagctaggctagtgtttaggataaaacaggactacagggaagaatttgaaaagttattggacgatagtccgggactttttgaagctcttaacttgggtcatcaggctcattttaaggagaaggttttatcagttttagatttttctactcctggtagaactgctgctgctgtagcttttcttacttttatattggataaatggatccgccaaactcacttcagcaagggatacgttttggatttcatagcagcagctttgtggagaacatggaaggctcgcaggatgaggacaatcttagattactggccagtgcagcctctgggagtagcagggatactgagacacccaccgaccatgccagcggttctgcaggaggagcagcaggaggacaatccgagagccggcctggaccctccggtggaggagtagctgacctgtttcctgaactgcgacgggtgcttactaggtctacgaccagtggacagaacaggggaattaagagggagaggaatcctagtgggaataattcaagaaccgagttggctttaagtttaatgagccgcaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacaatatagaattactaagaagattaatattagaaatgcatgctacatatcagggaatggggcagaggttataatagatacacaagataaagcagtttttagatgttgtatgatgggtatgtggccaggggttgtcggcatggaagcagtaacacttatgaatattaggtttaaaggggatgggtataatggcattgtatttatggctaacactaagctgattctacatggttgtagcttttttgggtttaataatacgtgtgtagaagcttgggggcaagttagtgtgaggggttgtagtttttatgcatgctggattgcaacatcaggtagggtcaagagtcagttgtctgtgaagaaatgcatgtttgagagatgtaatcttggcatactgaatgaaggtgaagcaagggtccgccactgcgcagctacagaaactggctgcttcattctaataaagggaaatgccagtgtgaagcataatatgatctgtggacattcggatgagaggccttatcagatgctgacctgcgctggtggacattgcaatattcttgctaccgtgcatatcgtttcacatgcacgcaaaaaatggcctgtatttgaacataatgtgattaccaagtgcaccatgcacataggtggtcgcaggggaatgtttatgccttaccagtgtaacatgaatcatgtgaaggtaatgttggaaccagatgccttttccagagtgagcttaacaggaatctttgatatgaatattcaactatggaagatcctgagatatgatgacactaaaccaagggtgcgcgcatgcgaatgcggaggcaagcatgctagattccagccggtgtgcgtggatgtgactgaagacttgagacccgatcatttggtgcttgcctgcactggagcggagttcggttctagtggtgaagaaactgactaaagtgagtagtggggcaagatgtggatggggactttcaggttggtaaggtgggcagattgggtaaattttgttaatttctgtcttgcagctgccatgagtggaagcgcttcttttgaggggggagtatttagcccttatctgacgggcaggctcccaccatgggcaggagttcgtcagaatgtcatgggatccactgtggatgggagacccgtccagcccgccaattcctcaacgctgacctatgccactttgagttcgtcaccattggatgcagctgcagccgccgccgctactgctgccgccaacaccatccttggaatgggctattatggaagcatcgttgccaattccagttcctctaataacccttcaaccctggctgaggacaagctacttgttctcttggcgcagctcgaggccttaacccaacgcttaggcgaactgtctaagcaggtggcccagttgcgtgagcaaactgagtctgctgttgccacagcaaagtctaaataaagatctcaaatcaataaataaagaaatacttgatataaaacaaatgaatgtttatttgatttttcgcgcgcggtatgccctggaccatcggtctcgatcattgagaacgcggtggatcttttccagtaccctgtaaaggtgggattgaatgtttagatacatgggcattagtccgtctcgggggtggagatagctccattgaagagcctcttgctccggggtagtgttataaatcacccagtcatagcaaggtcggagtgcatggtgttgcacaatatcttttaggagcagactaattgcaacggggaggcccttagtgtaggtgtttacaaatctgttgagctgggacgggtgcatccggggtgaaattatatgcattttggactggatcttgaggttggcaatgttgccgcctagatcccgtctcgggttcatattgtgcaggaccaccaagacagtgtatccggtgcacttgggaaatttatcatgcagcttagagggaaaagcatgaaaaaatttggagacgcctttgtgaccccccagattctccatgcactcatccataatgatagcgatggggccgtgggcagcggcacgggcgaacacgttccgggggtctgaaacatcatagttatgctcctgagtcaggtcatcataagccattttaataaactttgggcggagggtgccagattgggggatgaaagttccctctggcccgggagcatagtttccctcacatatttgcatttcccaggctttcagttcagagggggggatcatgtccacctgcggggctataaaaaataccgtttctggagccggggtgattaactgggacgagagcaaattcctaagcagctgagacttgccgcacccagtgggaccgtaaatgaccccaattacgggttgcagatggtagtttagggaacgacagctgccgtcctcccggagcaggggggccacttcgttcatcatttcccttacatggatattttcccgcaccaagtccgttaggaggcgctctcccccaagggatagaagctcctggagcgaggagaagtttttcagcggcttcagcccgtcagccatgggcattttggaaagagtctgttgcaagagctcgagccggtcccagagctcggtgatgtgctctatggcatctcgatccagcagacctcctcgtttcgcgggttgggacggctcctggagtagggaatcagacgatgggcgtccagcgctgccagggtccgatccttccatggtcgcagcgtccgagtcagggttgtttccgtcacggtgaaggggtgcgcgcctggttgggcgcttgcgagggtgcgcttcagactcatcctgctggtcgagaaccgctgccgattggcgccctgcatgtcggccaggtagcagtttaccatgagttcgtagttgagcgcctcggccgcgtggcctttggcacggagcttacctttggaagttttatggcaggcggggcagtagatacatttgagggcatacaacttgggcgcgaggaaaatggattcgggggagtatgcatccgcaccgcaggaggcgcagacggtttcgcactccacgagccaggtcagatccggctcatcggggtcaaaaacaagttttccgccatgttttttgatgcgtttcttacctttggtttccatgagttcgtgtccccgctgggtgacaaagaggctgtccgtgtccccgtagaccgactttatgggcctgtcctcgagcggagtgcctcggtcctcttcgtagaggaacccagcccactctgatacaaaagcgcgtgtccaggccagcacaaaggaggccacgtgggaggggtagcggtcgttgtcaaccagggggtccaccttctctacggtatgtaaacacatgtccccctcctccacatccaagaatgtgattggcttgtaagtgtaggccacgtgaccaggggtccccgccgggggggtataaaagggggcgggcctctgttcgtcctcactgtcttccggatcgctgtccaggagcgccagctgttggggtaggtattccctctcgaaggcgggcatgacctctgcactcaggttgtcagtttctaggaacgaggaggatttgatattgacagtaccagcagagatgcctttcataagactctcgtccatctggtcagaaaacacaatcttcttgttgtccagcttggtggcaaatgatccatagagggcattggatagaagcttggcgatggagcgcatggtttggttcttttccttgtccgcgcgctccttggcggtgatgttaagctggacgtactcgcgcgccacacatttccattcaggaaagatggttgtcagttcatccggaactattctgattcgccatcccctattgtgcagggttatcagatccacactggtggccacctcgcctcggaggggctcattggtccagcagagtcgacctccttttcttgaacagaaaggggggagggggtctagcatgaactcatcaggggggtccgcatctatggtaaatattcccggtagcaaatctttgtcaaaatagctgatggtggcgggatcatccaaggtcatctgccattctcgaactgccagcgcgcgctcataggggttaagaggggtgccccagggcatggggtgggtgagcgcggaggcatacatgccacagatatcgtagacatagaggggctcttcgaggatgccgatgtaagtgggataacatcgcccccctctgatgcttgctcgcacatagtcatagagttcatgtgagggggcaagaagacccgggcccagattggtgcggttgggtttttccgccctgtaaacgatctggcgaaagatggcatgggaattggaagagatagtaggtctctggaatatgttaaaatgggcatgaggtaagcctacagagtcccttatgaagtgggcatatgactcttgcagcttggctaccagctcggcggtgatgagtacatccagggcacagtagtcgagagtttcctggatgatgtcataacgcggttggcttttcttttcccacagctcgcggttgagaaggtattcttcgtgatccttccagtactcttcgaggggaaacccgtctttttctgcacggtaagagcccaacatgtagaactgattgactgccttgtagggacagcatcccttctccactgggagagagtatgcttgggctgcattgcgcagcgaggtatgagtgagggcaaaagtgtccctgaccatgactttgaggaattgatacttgaagtcgatgtcatcacaggccccctgttcccagagttggaagtccacccgcttcttgtaggcggggttgggcaaagcgaaagtaacatcattgaagaggatcttgccggccctgggcatgaaatttcgggtgattttgaaaggctgaggaacctctgctcggttattgataacctgagcggccaagacgatctcatcaaagccattgatgttgtgccccactatgtacagttctaagaatcgaggggtgcccctgacatgaggcagcttcttgagttcttcaaaagtgagatctgtagggtcagtgagagcatagtgttcgagggcccattcgtgcacgtgagggttcgctttaaggaaggaggaccagaggtccactgccagtgctgtttgtaactggtcccggtactgacgaaaatgctgtccgactgccatcttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtactcgcagcgattcacgggatgcaccttatgaatgagttgtacctgacttcctttgacgagaaatttcagtggaaaattgaggcctggcgcttgtacctcgcgctttactatgttgtctgcatcggcatgaccatcttctgtctcgatggtggtcatgctgacgagccctcgcgggaggcaagtccagacctcggcgcggcaggggcggagctcgaggacgagagcgcgcaggccggagctgtccagggtcctgagacgctgcggagtcaggttagtaggcagtgtcaggagattaacttgcatgatcttttggagggcgtgagggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcgccagagttgtcctggtaggcgatctcggccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacagcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagcgcttccaagcgctccatggcctcgtagaagtccacggcaaagttaaaaaactgggagttacgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtctcggtgacggcacgaccgttctccctgggtctcagagtgaagacgcctccgcgcatctccctgaagtggtgactgggaggctctccgttgggcagggacaccgcgctgattatgcattttatcaattgccccgtaggtactccgcgcaaggacctgatcgtctcaagatccacgggatctgaaaacctttcgacgaaagcgtctaaccagtcgcaatcgcaaggtaggctgagcactgtttcttgcgggcgggggcggctagacgctcggtcggggttctctctttcttctccttcctcctcttgggagggtgagacgatgctgctggtgatgaaattaaaataggcagttttgagacggcggatggtggcgaggagcaccaggtctttgggtccggcttgttggatacgcaggcgatgagccattccccaagcattatcctgacatctggccagatctttatagtagtcttgcatgagtcgttccacgggcacttcttcttcgcccgctctgccatgcatgcgagtgatcccgaacccgcgcatgggctggacaagtgccaggtccgctacaaccctttcggcgaggatggcttgctgcacctgggtgagggtggcttggaagtcgtcaaagtccacgaagcggtggtaggccccggtgttgattgtgtaggagcagttggccatgactgaccagttgactgtctggtgcccagggcgcacgagctcggtgtacttgaggcgcgagtatgcgcgggtgtcaaagatgtaatcgttgcaggtgcgcaccaggtactggtagccaatgagaaagtgtggcggtggctggcggtacaggggccatcgctctgtagccggggctccgggggcgaggtcttccagcatgaggcggtggtagccgtagatgtacctggacatccaggtgataccggaggcggtggtggatgcacgtgggaactcgcgcacgcggttccagatgttgcgcagcggcatgaagtagttcatggtaggcacggtctggccagtgaggcgcgcgcagtcattgacgctctgtagacacggagaaaacgaaagcgatgagcggctcgactccgtggtctgggggaacgtgaacgggttgggtcgcggtgtaccccggttcgagtccaaagctaagcgatcacgctcggatcggccggagccgcggctaacgtggtattggctatcccgtctcgacccagccgacgaatatccagggtacggagtagagtcgtttttgctgctttttcctggacgtgtgccattgccacgtcaagctttagaacgctcagttctcgggccgtgagtggctcgcgcccgtagtctggagaatcagtcgccagggttgcgttgcggtatgccccggttggagcctaagcgcggctcgtatcggccggtttccgcgacaagcgagggtttggcagccccgttatttccaagaccccgccagccgacttctccagtttacgggagcgagcccttttttttttttttttgtttttgtcgcccagatgcatccagtgctgcgacagatgcgcccccagcaacaggccccttctcagcaacagccacaaaaggctcttcttgctcctgcaactactgcagctgcagccgtgagcggcgcgggacagcccgcctatgatctggacttggaagagggcgagggattggcgcgcctgggggctccatcgcccgagcggcacccgcgggtgcaactaaaaaaggactctcgcgaggcgtacgtgccccagcagaacctgttcagggacaggagcggcgaggagccagaggagatgcgagcatctcgatttaacgcgggtcgcgagctgcgccacggtctggatcgaagacgggtgctgcaagacgaggattttgaggtcgatgaagtcacagggatcagcccagctagggcacatgtggccgcggccaacctagtctcggcctacgagcagaccgtgaaggaggagcgcaacttccaaaaatcttttaacaaccatgtgcgcaccctgatcgcccgcgaggaagtgaccctgggtctgatgcatctgtgggacctgatggaggctatcgcccaaaaccccactagcaaaccactgacagctcagctgtttctggtggttcaacatagcagggacaacgaggcattcagggaggcgttgttgaacatcaccgagcctgatgggagatggctgtatgatctgatcaacatcctgcaaagtattatagtgcaggaacgtagcctgggtttggctgagaaagtggcagctatcaactactcggtcttgagcctgggcaaatactacgctcgcaagatctacaagaccccctacgtacccatagacaaggaggtgaagatagatgggttttacatgcgcatgactctgaaggtgctgactctgagcgacgatctgggggtgtatcgcaatgacaggatgcaccgcgcggtgagcgccagcaggaggcgcgagctgagcgacagagaacttatgcacagcttgcaaagagctctaacgggggccgggactgatggggagaactactttgacatgggagcggatttgcaatggcaacccagtcgcagggccatggaggctgcagggtgtgagcttccttacatagaagaggtggatgaagtcgaggacgaggagggcgagtacttggaagactgatggcgcgacccgtatttttgctagatggaacagcagcaggcaccggaccccgcaatgcgggcggcgctgcagagccagccgtccggcattaactcctcggacgattggacccaggccatgcaacgcataatggcgctgacgacccgcaaccccgaagcctttagacagcaaccccaggccaaccgcctttctgccatactggaggccgtagtgccctcccgctccaaccccacccacgagaaggtcctggctatcgtgaacgcgctggtggagaacaaggccatccgtcccgatgaggccgggctggtatacaatgctctcttggagcgcgtggcccgttacaacagcagcaacgtgcaaaccaacctggaccggatggtgaccgatgtgcgcgaggccgtgtctcagcgcgagcgattccagcgcgacgccaacttggggtcgttggtagcgctaaacgctttcctcagcacccagcccgccaacgtgccccgtggtcagcaagactatacaaactttttgagtgcattgagactcatggtagctgaggtgccccagagcgaggtgtaccagtccgggccagattacttcttccagaccagcagacagggcttgcagacagtgaacctgactcaggctttcaagaacctgaagggtctgtggggagtgcacgccccagtaggggatcgcgcgaccgtgtctagcttgctgactcccaactcccgcctgctgctgctgctggtatccccctttactgacagcggtagcattgaccgcaactcgtacttgggctacctgcttaacctgtatcgcgaggccataggacagagccaggtggacgagcagacctatcaagaaatcacccaagtgagccgcgccctgggtcaggaagacacgggcagtttggaagccaccctgaacttcttgctaaccaaccggtcacagaagatccctcctcagtatgcgcttaccgctgaggaggagcggatcctcagatacgtgcaacagagcgttggactgttcctgatgcaggagggggcgacacctaccgccgcgctggacatgacagctcgaaacatggagcccagcatgtatgctagtaacaggcctttcattaacaaactgctggactacctgcacagggcggccgccatgaactctgattatttcaccaatgctatcctgaacccacactggctgcccccacctggtttctacactggcgagtacgacatgcccgaccccaatgacgggttcctgtgggacgatgtggacagcagcatattttccccgcctcccggttatacagtttggaagaaggaagggggcgatagaagacactcttccgtgtcgctatccggaacggctggtgctgccgcgaccgtgcccgaagctgcaagtcctttccctagcttgcccttttcactaaacagcgttcgcagcagtgaactggggagaataacccgcccgcgcttgatgggcgaggatgagtacttgaatgactctttgctgaggccagagagggaaaagaacttccccaacaatggaatagagagtctggtggataagatgagtagatggaagacctatgcgcaggatcacagagacgagcccaggatcttgggggctacaagcagaccgatccgtagacgccagcgccacgacaggcagatgggtcttgtgtgggacgatgaggactctgccgatgatagcagcgtgttggacttgggtggaagaggagggggcaacccgttcgctcatctgcgtcccagattcgggcgcatgttgtaaaagtgaaagtaaaataaaaaggcaactcaccaaggccatggcgaccgagcgtgcgttcgttcttttttgttatctgtgtctagtacgatgaggagacgagccgtgctaggcggagcggtggtgtatccggagggtcctcctccttcttacgagagcgtgatgcagcaacaggcggcgatgatacagcccccactggaggctcccttcgtacccccacggtacctggcgcctacggaagggagaaacagcattcgttactcggagctgtcgcccctgtacgataccaccaagttgtatctggtggacaacaagtcggcggacatcgcctccctgaactatcagaacgaccacagcaacttcctgaccacggtggtgcagaacaatgactttacccccacggaggctagcacccagaccatcaactttgacgagcggtcgcgatggggcggtcagctgaagaccatcatgcacaccaacatgcccaacgtgaacgagtacatgttcagcaacaagttcaaggcgagggtgatggtgtccagaaaagctcctgaaggtgttacagtaaatgacacctatgatcataaagaggatatcttgaagtatgagtggtttgagttcattttaccagaaggcaacttttcagccaccatgacgatcgacctgatgaacaatgccatcattgacaactacctggaaattggcagacagaatggagtgctggaaagtgacattggtgttaagtttgacactagaaatttcaggctcgggtgggaccccgaaactaagttgattatgccaggtgtctacacttatgaggcattccatcctgacattgtattgctgcctggttgcggggtagactttactgaaagccgacttagcaacttgcttggcatcaggaagagacatccattccaggagggtttcaaaatcatgtatgaagatcttgaagggggtaatattcctgcccttttggatgtcactgcctatgaggaaagcaaaaaggataccactactgaaacaaccacactggctgttgcagaggaaactagtgaagatgatgatataactagaggagatacctatataactgaaaaacaaaaacgtgaagctgcagctgctgaagttaaaaaagagttaaagatccaacctctagaaaaagacagcaagagtagaagctacaatgtcttggaagacaaaatcaacacagcctaccgcagttggtacctgtcctacaattacggtaaccctgagaaaggaataaggtcttggacactgctcaccacttcagatgtcacctgtggggcagagcaggtctactggtcgctccctgacatgatgcaagacccagtcaccttccgctccacaagacaagtcaacaactacccagtggtgggtgcagagcttatgcccgtcttctcaaagagtttctacaatgagcaagccgtgtactctcagcagctccgacaggccacttcgctcacgcacgtcttcaaccgcttccctgagaaccagatcctcatccgcccgccggcgcccacaattaccaccgtcagtgaaaacgttcctgctctcacagatcacgggaccctgccgttacgcagcagtatccggggagtccagcgcgtgaccgttactgacgccagacgccgcacctgtccctacgtttacaaggccctgggcatagtcgcgccgcgcgttctttcaagccgcactttctaaaaaaaaaaaaaaaatgtccattctcatctcgcccagtaataataccggttggggactgtatgcgcccaccaagatgtatggaggcgcccgcaagcgctctacccagcatcctgtgcgcgttcgcggtcatttccgcgctccctggggcgcactcaagggtcgtacccgcactcggaccacggtcgatgatgtgatcgaccaggtggtcgccgatgctcgtaattatactcctactgcgcctacatctactgtggatgcagttattgacagtgtggtggcagacgcccgcgcctatgctcgccggaagagccgaaggaggcgcatcgccaggcgccacagggctactcccgccatgcgagccgcaaaagctattctgcggagggccaaacgtgtggggcgaagagccatgcttagagcggccagacgcgcggcttcaggtgccagcagcggcaggtcccgcaggcgcgcggccacggcggcagcagcggccattgccaacatggcccaaccgcgaagaggcaatgtgtactgggtgcgtgatgccactaccggccagcgcgtgcccgtgcgcacccgcccccctcgcacttagaagatactgagcagtctccgatgttgtgtcccagcggcaagtatgtccaagcgcaaatacaaggaagagatgctccaggtcatcgcgcctgaaatctacggtccgccggtgaaggatgaaaaaaagccccgcaaaatcaagcgggtcaaaaataacaaaaaggaagaagatgacgatgatgggctggtggagtttgtgcgcgagttcgccccaagacggcgcgtgcagtggcgcgggcgcaaagtgcgtcaagtgctcagacccgggaccactgtggtttttacacctggcgagcgttccagcactacttttaaacggtcctatgatgaggtgtacggggatgacgatattcttgagcaggcggcagaccgccttgacgagtttgcttatggcaagcgcactagatccagtcccaaagaggaggctgtgtccattcctttggatcatggaaatcccacccccagcctcaaaccagtcaccctgcagcaagtgctgcccgtgcctgcgcggagaggcgtaaagcgcgagggtgaggacctatatcccaccatgcagctaatggtgcccaagcgccagaggctagaagacgtactggagaaaatgaaagtggatgccgatatccagcctgaggtcaaagtaagacctatcaaggaagtggcgccaggtttgggagtacaaaccttcgacatcaagattcccaccgagtccatggaagtgcagaccgaacctgcaaaacccaccacctcaattgaggtgcaaacggaaccctggatgcccgcgcccgttgccgcccccagcaccactcgaagatcacgacgaaagtacggcccagcaagtctgctaatgcccaactatgctctgcacccatccatcattcccactccgggttacagaggcactcgctactatcgaaaccggagcaacacctctcgccgccgcaaaccacctgcaagtcgcactcgccgtcgccgccgccgcaacactgccagcaaattgactcccgccgccctggtgcggagagtgtaccgcgatggtcgcgctgaacctctgacgctgccgcgcgcgcgctaccatccaagcatcaccacttaatgactgttgacgctgcctccttgcagatatggccctcacttgccgccttcgcgtccccattactggctaccgaggaagaaactcgcgccgtagaaggatgttggggcgagggatgcgccgccacagacgaaggcgcgctatcagcagacgattagggggtggctttttgccagctcttatacccatcatcgccgcagcgatcggggcgataccaggcatagcttcagtggcggttcaggcctcgcagcgccactaacattggaaaaaacttataaataaaaaatagaatggactctgacgctcctggtcctgtgactatgtttttgtagagatggaagacatcaatttttcatccctggctccgcgacacggcacgaggccgtacatgggcacctggagcgacatcggcacgagccaactgaacgggggcgccttcaattggagcagtatctggagcgggcttaaaaattttggctcgaccgtaaaaacctatgggaacaaagcttggaacagcagcacagggcaggctctgagaaataagcttaaggaacaaaacttccaacagaaggtggtcgatgggatcgcctctggtattaacggcgtagtggatctggccaaccaggctgtacaaaaacagataaacagccgcctggacccgccgcccgcaacccctggtgaaatggaagtggaggaagaacttcctccgctggaaaagcggggcgacaagcgtccgcgacccgagctagagcagacgctggtgacgcgcgcagacgagcccccttcatatgaggaggcagtaaagctcggaatgcccactaccaggcctgtagctcacatggctaccggggtgatgaaaccttctcagtcacatcgacccgccaccttggacttgcctcctccccctgcttctgcggcgcctgttcccaaacctgtcgctaccagaaagcccaccgccgtacagcccgtcgccgtagccagaccgcgtcctgggggcacaccgcgcccgaaagcaaactggcaaagtactctgaacagcatcgtgggtctgggcgtgcagagtgtaaagcgccgtcgctgctattaattaaatatggagtagcgcttaacttgcttgtctgtgtgtatgtatcatcaccacgccgccgcagcagaggagaaaggaagaggtcgcgcgccgaggctgagttgctttcaagatggccaccccatcgatgatgccccaatgggcatacatgcacatcgccggacaggatgcttcggagtacctcagtccgggtctggtgcagttcgcccgtgcaacagacacctacttcagtatggggaacaaatttagaaaccccacagtggcgcccacccacgatgtgaccaccgaccgtagccagcgcctgatgctgcgcttcgtgcccgttgaccgggaagacaatacctactcttacaaagttcgctacacgctggctgtaggcgacaacagagtgcttgacatggccagcacattctttgacattcggggggtgcttgatagaggtcctagcttcaagccatattccggcacagcttacaattcactcgctcctaagggcgcgcccaatacatctcagtggatagttacaacaaatggggacaatgcagtaactaccaccacaaacacatttggcattgcttccatgaagggagacaatattactaaagaaggtttgcaaattgggaaagacattaccactactgaaggagaagaaaagcccatttatgccgataaaacatatcagccagagcctcaagttggagaagaatcatggactgatactgatggaacaaatgaaaagtttggtggaagagcccttaaaccagctaccaacatgaagccatgctacgggtcttttgcaagacctacaaacataaaagggggccaagctaaaaacagaaaagtaaaaccaacaaccgaaggaggggttgaaactgaggaaccagatattgatatggaatttttcgatggtagagatgctgttgcaggagctttagcgcctgaaattgtgctttatacggaaaatgtaaatttggaaactccagacagtcatgtggtatataaaccagaaacgtctaataactctcatgcaaatttgggtcaacaagccatgcctaacagacccaattacattggcttcagggataacttcgtaggcctaatgtactacaacagtactggaaatatgggagttttggctggccaagcatcacaactgaatgcagtggttgacttgcaggacagaaatactgaactgtcatatcagcttttgcttgattctctgggagacagaaccagatacttcagcatgtggaatcaggctgtggacagttacgatcccgatgttcgcattattgaaaatcatggcatcgaggatgaactgcctaattactgttttcctctgaatggcataggaccagggcacacatatcaaggcattaaagttaaaaccgatgacactaatggatgggaaaaagatgctaatgttgctccagctaatgaaataaccataggcaacaacctggctatggaaattaatatccaagctaacctttggagaagttttctgtactctaatgtggctttgtaccttccagatgtttacaagtacacgccacctaacattactttgcccactaacaccaacacctatgagtacatgaacgggcgagtggtatccccatccctggttgattcatacatcaacattggcgccaggtggtctcttgacccaatggacaatgtgaatccattcaaccaccaccgcaatgctggtctgcgctacaggtccatgcttctgggaaatggtcgttatgtgcctttccacatacaagtgcctcagaaattctttgctgtcaagaacctacttcttctacctggctcctacacctacgagtggaacttccgaaaggatgtgaacatggtcctgcaaagttcccttggaaatgacctcagaacggatggtgctaccataagtttcaccagcatcaatctctatgccaccttcttccccatggctcacaacacagcttccacccttgaagccatgctgcgcaacgataccaatgatcagtcatttaacgactacctctctgcagctaacatgctttaccccattcctgccaatgcaaccaacattccaatttccatcccatctcgcaactgggcagccttcaggggctggtccttcaccagactcaaaaccaaggagactccatctcttggatcagggttcgatccctacttcgtatattctggatctattccctacctggatggcaccttttaccttaaccacactttcaagaaggtctccatcatgtttgactcctcagtcagctggcctggcaatgacaggctgttgagtccaaatgagtttgaaatcaagcgcactgtggacggggaaggatacaacgtggcacaatgcaacatgaccaaagactggttcctggttcagatgcttgccaattacaacattggctaccagggcttttacatccctgagggatacaaggatcgcatgtactcctttttcagaaacttccagcctatgagcaggcaggtggttgatgaggttaattacactgactacaaagccgtcaccttaccataccaacacaacaactctggctttgtagggtaccttgcacctactatgagacaaggggaaccttacccagccaattatccatacccgctcatcggaactactgccgttaagagtgtcacccagaaaaagttcctgtgcgacaggaccatgtggcgcattcccttctccagcaacttcatgtccatgggggcccttaccgacctgggacagaacatgctctatgccaactcagcccatgcgctggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataagaagcctcttgcttcttgcaagcagcagctgcagccatgacatgcgggtccggaaacggctccagcgagcaagagctcaaagccatcgtccgagacctgggctgcggaccctatttcctgggaacctttgacaagcgtttcccggggttcatggcccccgacaagctcgcctgcgccatagtcaacactgccggacgcgagacggggggagagcactggctggcttttggttggaacccgcgctacaacacctgctacctttttgatccttttgggttctcggatgagcggctcaaacagatttaccagtttgagtacgaggggctcctgcgtcgcagtgcccttgctaccaaagaccgctgcatcaccctggagaagtctacccaaagcgtgcagggtccgcgctcagccgcctgtggacttttttgctgtatgttccttcatgcctttgtgcactggcccgaccgccccatggacggaaaccccaccatgaagttgctgactggggtgtccaacagcatgctccaatcaccccaagtccagcccaccctgcgccgcaaccaggaggtgctataccgcttcctaaacacccactcatcttactttcgttctcaccgcgcgcgcattgaaagggccaccgcgtttgaccgtatggatatgcaataagtcatgtaaaaccgtgttcaataaacagcactttatttttacatgcactgaggctctggttttgctcatttgtttcatcatttactcagaagtcgaatgggttctggcgggagtcagagtgacccgcgggcagggatacgttgcggaactgtaacctgttctgccacttgaactcggggattaccagcttgggaactggaatctcgggaaaggtgtcttgccacaactttctggtcagttgcatagcgccaagcaggtcaggagcagagatcttgaaatcacagttggggccggcattctggacacgggagttgcgatacactgggttgcaacactggaacactatcaacgctgggtgtcttacgcttgccaacacggttgggtcactgatggtagtcacatccaagtcttcagcattggccatcccaaagggggtcatcttacatgtctgcctgcccatcacgggagcgcagcctggcttgtggttgcaatcacaatgaatggggatcagcatcatcctggcttggtcgggagttatccctgggtacacagccttcatgaaggcttcgtactgcttaaaagcttcctgggccttacttccctcggtgtagaacatcccacaggacttgctggaaaattgattagtagtacagttggcatcattcacacaacagcgggcatcgttgttggccaactgaaccacatttctgccccagcggttttgggtgatcttggctctgtctggattctccttcatagcgcgctgcccgttctcgctcgccacatccatctcgataatgtggtccttctggatcatgatagtgccatgcaggcatttcaccttgccttcataatcggtgcatccatgagcccacagagcgcacccggtgcactcccaattattgtgggcgatctcagaataataatgtaccaatccctgcatgaatcttcccatcattgttgtcaaggtcttcatgctggtaaatgtcagcgggatgccacggtgctcctcgttcacatactggtggcagatacgcttgtattgctcgtgctgctctggcatcagcttgaaagaggttctcagatcattatccagcctgtacctttccattagcacagccatcacttccatgcccttctcccaggcagataccaggggcagactcaaaggattcctaacagcaataaaagtagctcctttagctatagggtcattcttgtcgatcttctcaacacttctcttgccatccttctcaatgatgcgcaccggggggtagctgaagcccacggccaccaactgagcctgttctctttcttcttcactatcctggctgatgtcttgcagagggacatgcttggtcttcctgggcttcttcttgggagggatcgggggaggactgttgctccgctccggagacagggatgactgcgaagtttcgcttaccaataccacctggctctcggtagaagaaccggaccccacacgacggtaggtgttcctcttcgggggcagaggtggaggcgactgagatgggctgcggtctggccttggaggcggatggctggcagagctcattccgcgttcgggggtgtgctcccggtggcggtcgcttgactgatttcctccgcggctggccattgtgttctcctaggcagagaaacaacagacatggaaactcagccatcactgccaacatcgctgcaagcaccatcacacctcgcccccagcagcgacgaggaggagagcttaaccaccccaccacccagtcccgctaccaccacctctaccctcgatgatgaggaggaggtcgacgcagcccaggagatgcaggcgcaggataatgtgaaaacggaagagattgaggcagatgtcgagcaggacccgggctatgtgacgccggcggagcaccaggaggagctgaaacgctttctagacagagaggatgacgaccgcccagagcatcaagcagatggcgtttaccaggaggctgggatcagggatcatgtcgccgactacctcaccggccttggtggggaggacgtgctcctcaaacatctagcaaggcagtcgatcatagttaaagacgcattgctcgatctcactgaagtgcccatcagtgtggaagagcttagccgcgcctacgagctgaacctcttttcgcctcaggtaccccccaagcggcagccaaacggcacctgcgaggccaaccctcgactcaacttctatccagcttttactatccccgaagtgttggccacctaccacatctttttcaagaaccaaaagattccagtctcctgccgcgccaaccgcacccgcgccgatgccctgctcaacttgggtccgggagctcgcttacctgatatagcttccttggaagaggttccaaagatctttgagggtctgggaagtgatgagacacgggccgcaaatgctctgcaacagggagagaatgacatggatgaacaccacagcgctctggtggaactggagggtgacaatgcccggattgcagtgctcaagcgcagtatcgtggtcacccattttgcctaccccgctgttaacctgccccccaaagttatgagcgctgtcatggaccatctgctcatcaaacgagcaagacctctttcagaaaaccagaacatgcaggatccagacgcctcggacgagggcaagccggtagtcagtgacgagcagctatctcgctggctgggtaccaactccccccgagatttggaagagaggcgcaagcttatgatggctgtagtgctagtaactgtggagctggagtgtctgcgccgctttttcaccgaccctgagaccctgcgcaagctagaggagaacctgcactacacctttagacatggcttcgtgcggcaggcatgcaagatctccaacgtggagcttaccaacctggtttcttacatgggcattttgcatgagaaccgactagggcagagcgtcctgcacaccacccttaaaggggaggcccgccgtgactacatccgagactgtgtctacctctacctctgccatacctggcaaactggtatgggtgtgtggcaacagtgtttggaagagcagaacctaaaagagctggacaagctcttgcagagatccctcaaagccctgtggacaggttttgatgagcgcaccgtcgcctcggacctggcagacatcatcttccccgagcgtctcagggttactctgcgaaacggcctgccagactttatgagccagagcatgcttaacaactttcgctctttcatcctggaacgctccggtatcctgcctgccacctgctgtgcgctgccctccgactttgtgcctctcacctaccgcgagtgcccaccgccgctatggagccactgctacctgttccgcctggccaactacctctcctaccactcggatgttatagaggatgtgagcggagacggcctgctggaatgccactgccgctgcaatctttgcacaccccaccgctcccttgcctgcaacccccagttgctgagcgagacccagattatcggcaccttcgagctgcagggtcccagaagtaaaggcgaggggtcttctccggggcagagtttgaaactgacaccggggctgtggacctccgcctacctgcgcaagtttcaccccgaggactaccatccctatgagatcaggttctatgaggaccaatcacatcctcccaaagtcgagctctcagcctgcgtcatcacccagggagcaattctggcccaattgcaagccatccaaaaatctcgccaagaatttctgctaaaaaagggaaacggggtctaccttgaccctcagaccggtgaggagctcaacacaaggttcccccaggatgtcccatcgccgaggaagcaagaagttgaaggtgcagctgtcgcccccagaggatatgaaggaagactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggggcccagcggcggcccaacagtagatgggacgagaccgggcgattcccaaacccgaccaccgcttccaagaccggtaagaaggagcgacagggatacaagtcctggcgtggacataaaaacgctatcatctcctgcttgcatgaatgcgggggcaacatatccttcacccggcgatacctgctcttccaccacggtgtaaacttcccccgcaatatcttgcattactaccgtcacctccacagcccctactgcagtcagcaagtcccggcaaccccgacagaaaaatacagcagcgacaacggtgaccagaaaaccagcagttagaaaatccacaacaagtgcaccaggaggaggactgaggatcacagcgaacgagccagcgcagaccagagagctgaggaaccggatctttccaaccctctatgccattttccagcagagtcgggggcaagagcaggaactgaaagtaaaaaaccgatctctgcgctcgctcaccagaagttgtttgtatcacaagagcgaagaccaacttcagcgcactctcgaggacgccgaggctctcttcaacaagtactgcgcgctgactcttaaagagtagcccttgcccgcgctcattttgaaaacggcgggaatcacgtcacccttggcacctgtcctttgcccttgtcatgagtaaagagattcccacgccttacatgtggagctatcagccccaaatggggttggcagcaggcgcttcccaggactactccacccgcatgaattggcttagcgccgggccctcaatgatatcacgggttaatgatatacgagcttatcgaaaccagttactcctagaacagtcagctctcaccaccacaccccgtcaacaccttaatccccgaaattggcccgccaccctggtgtaccaggaaaatcccgctcccaccaccgtactacttcctcgagacgcccaggccgaagttcagatgactaacgcaggtgtacagctggcgggcggttccgccctatgtcgtcaccgacctcaacagagtataaaacgcctggtgattagaggccgaggtatccagctcaacgacgagtcggttagctcttcgcttggtctgcgaccagacggagtcttccaaatcgccggctgtgggagatcttccttcactcctcgtcaggctgtgctgactttggagagttcgtcctcgcagccccgctcgggcggcattggaactctccagtttgtggaggagtttactccctctgtctacttcaaccccttctccggctctcctggccagtacccggacgagttcataccaaacttcgacgcaatcagcgagtcagtggatggctatgattgatgtctaatggtggtgcggctgagctagctcgactgcgacacctagaccactgccgccgctttcgctgcttcgcccgggaactcaccgagttcatctacttcgaactctccgaggagcaccctcagggtccggcccacggagtgcggattaccatcgaagggggaatagactctcgcctgcatcgcatcttctcccagcggcccgtgctaattgaacgcgaccagggaaatacaaccatctccatctactgcatctgtaaccaccccggattgcatgaaagcctttgctgtcttgtttgtgctgagtttaataaaaactgagttaagaccctcctacggactaccgcttcttcaatcaggactttacaacaccaaccagatcttccagaagacccagacccttcctcctttcatccaggactctaactctaccttaccagcaccctccactactaaccttcccgaaacaaacaagcttgcatctcatctgcaacaccgcctttcacgaagccttctttctgccaatactaccactcccaaaaccggaggtgagctccgcggtcttcctactgacgacccctgggtggtagcgggttttgtaacgttaggagtagttgcgggtgggcttgtgctgatcctttgctacctatacacaccttgctgtgcatatttagtcatattgtgctgttggtttaagaaatgggggccatactagtcgtgcttgctttactttcgcttttgggtctgggctctgctaatctcaatcctctcgatcacgatccatgtttagacttcgacccagaaaactgcacacttacttttgcacccgacacaagccgtctctgtggagttcttattaagtgcggatgggactgcaggtccgttgaaattacacataataacaaaacatggaacaataccttatccaccacatgggagccaggagttccccagtggtatactgtctctgtccgaggtcctgacggttccatccgcattagtaacaacactttcattttttctgaaatgtgcgatctggccatgttcatgagcagacagtatgacctatggcctcccagcaaagagaacattgtggcattttccattgcttattgcttggtaacatgcatcatcactgctatcatttgtgtgtgcatacacttgcttatagttattcgccctagacaaagcaatgaggaaaaagagaaaatgccttaacctttttcctcataccttttctttacagcatggcttctgttacagctctaattattgccagcattgtcactgtcgctcacgggcaaacaattgtccatattaccttaggacataatcacactcttgtagggcccccaattacttcagaggttatttggaccaaacttggaagtgttgattattttgatataatttgcaacaaaactaaaccaatatttgtaatctgtaacagacaaaatctcacgttaattaatgttagcaaaatttataacggttactattatggttatgacagatccagtagtcaatataaaaattacttagttcgcataactcagcccaaattaacagtgccaactatgacaataattaaaatggctaataaagcattagaaaattttacatcaccaacaacacccaatgaaaaaaacattccaaattcaatgattgcaattattgcggcggtggcattgggaatggcactaataataatatgcatgctcctatatgcttgttactataaaaagtttcaacataaacaggatccactactaaattttaacatttaattttttatacagatgatttccactacaatttttatcattactagccttgcagctgtaacttatggccgttcacacctaactgtacctgttggctcaacatgtacactacaaggaccccaagaaggctatgtcacttggtggagaatatatgataatggagggttcgctagaccatgtgatcagcctggtacaaaattttcatgcaacggaagagacttgaccattattaacataacatcaaatgagcaaggcttctattatggaaccaactataaaaatagtttagattacaacattattgtagtgccagccaccacttctgctccccgcaaatccactttctctagcagcagtgccaaagcaagcacaattcctaaaacagcttctgctatgttaaagcttccaaaaatcgctttaagtaattccacagccgctcccaatacaattcctaaatcaacaattggcatcattactgccgtggtagtgggattaatgattatatttttgtgtataatgtactacgcctgctgctatagaaaacatgaacaaaaaggtgatgcattactaaattttgatatttaattttttatagaattatgatattgtttcaatcaaataccactacctcctatgcatacacaaacattcagcctaaatacgctatgcaactagaaatcacaatactaattgtaattggaattcttatactatctgttattctttattttatattctgccgtcaaatacccaatgttcatagaaattctaaaagacgtcccatctattctcctatgattagtcgtccccatatggctctgaatgaaatctaagatctttttttttttctcttacagtatggtgaacatcaatcatgatccctagaaatttcttcttcaccatactcatctgtgcttttaatgtctgtgctactttcacagcagtagccactgcaagcccagactgtataggaccatttgcttcctatgcactttttgccttcgttacttgcatctgcgtgtgtagcatagtctgcctggttattaattttttccaactggtagactggatctttgtgcgaattgcctacctacgtcaccatcccgaataccgcaatcaaaatgttgcggcacttcttaggcttatttaaaaccatgcaggctatgctaccagtcattttaattttgctactaccctgcattcccctagcttccaccgccactcgcgctacacctgaacaacttagaaaatgcaaatttcaacaaccatggtcatttcttgattgctaccatgaaaaatctgattttcccacatactggatagtgattgttggaataattaacatactttcatgtacctttttctcaatcacaatataccccacatttaattttgggtggaattctcccaatgcactgggttacccacaagaaccagatgaacatattccactacaacacatacaacaaccactagcactggtacagtatgaaaatgagccacaaccttcactgccccctgccattagttacttcaacctaaccggcggagatgactgacccaatcgccacatcatccaccgctgccaaggagctgctggacatggacggacgtgcctcagaacagcgactcatccaactacgcattcgtcagcagcaggaacgagcagtaaaagagctaagggatgccattgggattcaccagtgcaaaaaaggcatattctgcttagtaaaacaatccaaaatctcctacgagatcaccgctactgaccatcgtctctcatacgagctcggtccgcagcgacaaaaattcacctgcatggtgggaatcaaccccatagttatcacccagcagtctggagatactaagggttgtatccagtgttcctgtgattccaccgagtgcatctacacactgctgaagaccctctgcggccttcgagacctcctacccatgaactaatcattgcccctaccttacccaatcaaaatattaataaagacacttacttgaaatcagcaatacagtctttgtcaaaactttctaccagcagcacctcaccctcttcccaactctggtactctaaacgtcggagggtggcatactttctccacactttgaaagggatgtcaaattttatttcctcttctttgcccacaatcttcatttctttatccccagatggccaagcgagctcggctaagcacttccttcaacccggtgtacccttatgaagatgaaagcagctcacaacacccatttataaatcctggtttcatttcccctgacgggttcacacaaagtccaaacggggttttaagtcttaaatgtgttaatccacttaccactgcaagcggctccctccaacttaaagtgggaagtggtcttacagtagacactactgatggatccttagaagaaaacatcaaagttaacacccccctaacaaagtcaaaccattctataaatttaccaataggaaacggtttgcaaatagaacaaaacaaactttgcagtaaactcggaaatggtcttacatttgactcttccaattctattgcactgaaaaataacactttatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactgacaacaaaaataaagttcaacattttttattgaaattccttttacagtattcgagtagttattttgcctcccccttcccatttaacagaatacaccaatctctccccacgcacagctttaaacatttggataccattagagatagacatagttttagattccacattccaaacagtttcagagcgagccaatctggggtcagtaatacataaaaatgcatcgggatagtcttttaaagcgctttcacagtccaactgttgcggatgcgactccggagtctgaatcacggtcatctggaagaagaacgatgggaatcataatccgaaaacggaatcgggcgattgtgtctcatcaaacccacaagcaaccgctgtctgcgtcgctccgtgcgactgctgtttatgggatcggggtccgcagtgtcctgaagcatgattttaatagcccttaacattaactttctggtgcgatgcgcgcagcaacgcattctgatttcacttagattactacagtaggtacagcacattatcacaatattgtttaataaaccataattaaaagcgctccagccaaaactcatatctgatataatcgcccctgcatgaccatcataccaaagtttaatataaattaaatgtcgttccctcaaaaacacactacccacatacatgatctcttttggcatgtgcatattaacaatttgtctgtaccatggacaacgttggttaatcatgcaacccaatataaccttccggaaccacactgccaacaccgctcccccagccatgcattgaagtgaaccctgctgattacaatgacaatgaagaacccaattctctcgaccatgaatcacttgagactgaaaaatatctatagtagcacaacaaagacataaatgcatgcatcttctcataatttttaactcctctggatttaaaaacatatcccaaggaatgggaaactcttgcagaacagtaaagctggcagaacaaggaagaccacgaacacaacttacactatgcatagtcatagtatcacaatctggcaacagcgggtggtcttcagtcatagaagctcgggtttcattttcctcacatcgtggtaattgggctctggtgtaagggtgatgtctggcgcatgatgtggagcgtgcgcgcaaccttgtcataatggagttgcttcctgacattctcgtattttgtatagcaaaacgctgccctggcacaacacactcttcttcgtcttctatcctgccgcttagtgtgttccgtctgataattcaagtacagccacactcttaagttggtcaaaagaatgctggcttcagttgtaatcaaaactccatcatatttaattgttctaaggaaatcatccacggtagcatatgcaaatcccaaccaagcaatgcaactggattgcgtttcaagcagcagaggagagggaagagacggaagaatcatgttaatttttattccaaacgatctcgcagtacttcaaattgtagatcgcgcagatggcatctatcgcccccactgtgttggtgaaaaagcacagctaaatcaaaagaaatgcgattttcaaggtgctcaacggtggcttccaacaaagcctccacgcgcacatccaaaaacaaaagaataccaaaagaaggagcattttctaactcctcaaacatcatattacattcctgcaccattcccagataattttcagctttccagccttgaattattcgtgtcagttcttgtggtaaatccaaaccacacattacaaacaggtcccggagggcgccctccaccaccattcttaaacacaccctcataatgacaaaatatcttgctcctgtgtcacctgtagcaaattaagaatggcatcatcaattgacatgcccttggctctaagttcttctctaagttctagttgtagatactctctcatattatcaccaaactgcttagccagaagccccccgggaacaatagcaggggacgctacagtgcagtacaagcgcagacctccccaattggctccagcaaaaacaagattagaataagcatactgggaaccaccagtaatatcatcaaagttgctggaaatataatcaggcagagtttcttgtaaaaattgaataaaagaaaaattttccaaagaaacattcaaaaccgttgggatgcaaatacaataggttaccgcgctgcgctccaacattgttagttttgaattagtctgcaaaataaaagaaacaagcgtcatatcatagtagcctgtcgaacaggtggaaaaatcagtctttccatcacaagacaagccacagggtctccagctcgaccctcgtaaaacctgtcattgtgattaaacaacagcaccgaaagttcctcgcggtggccagcatgaataattcttgatgaagcatacaatccagacatgttagcatcagttaaagagaaaaaacagccaacatagcctctgggtataattatgcttaattttaagtatagcaaagccacccctcgcggatacaaagtaaaaggcacaggagaataaaaaatataattatttctctgctgctgttcaggcaacgttgctcccggtccctctaaatagacatacaaagcctcatcagccatggcttaccaggcaaagtacagcgggcgcacaaagcacaagctctaaagaagctctaaaaacactctccaacctctccacaatatatacacaagccctaaactgacgtaatgggagtaaagtgaaaaaaaaataccgccaagcccaacacacaccccgaaactgcgtcagcaggaaaaagtacagtttcacttccgcattcccaacaagcgtaacttcctctttctcatggtacgtcacatccgattaacttgcaacgtcattttcccacggtcgcgccgccccttttagccgttaaccccgcagccaatcaccacacagcgcgcacttttttaaattacctcatttacatgttggcaccattccatctataaggtatattatatagatag

SEQ ID NO: 576 - DNA, 35265 bp, Ad3FS NHRC#1276 from NTC Great Lakes, IL 11/07/97
catcatcaataatataccttatagatggaatggtgccaatatgcaaatgaggtaatttaaaaaagtgcgcgctgtgcggtgattggctgcggggtgaacggctaaacggggtgggatgacgctgtgaggtgacgtaacttttgtgggaggagttatgttgcaagttatcgcggtaaaggtgacgtaaaatgaggtgtggtttaaacacggaagtagacagttttcccacgcttactgacaggatatgaggtagttttgggcggatgcaagttaaaattctccattttggcgcgaaaactgaatgaggaagtgaatttctgagtcatttcgcggttatgacagggtggagtatttgccgagggccgagtagactttgaccgtttacgtggaggtttcgattaccgtggtttttacctaaatttccgcgtacggtgtcaaagtcctgtgttttttacgtaggtgtcagctgatcgctagggtatttaaacctgacgagttccgtcaagaggccactcttgagtgccagcgagaagagttttctcctccgcgccgcaagtcagttctgcgctttgaaaatgagacacctgcgtttcctgccacaggagattatctccagtgaaaccgggattgaaatactggagtttgtggtaaataccctaatgggagacgacccggaaccgccagtgcagccttttgatccacctacgctgcacgatctgtatgatttagaggtagacgggccggaggatcccaatgaggaagctgtgaatgggttttttactgattctatgctgctagctgccgatgaaggattggacataaaccctcctcctgagacccttgataccccaggggtggttgtggaaagcggcagaggtgggaaaaaattgcctgatctgggagcagctgaaatggacttgcgttgttatgaagagggttttcctccgagtgatgatgaagatggggaaattgagcagtctatccataccgcagtgaataagggagtaaaagctgccagcgatgtttttaagttggactgtccggagctgcctggacatggctgtaagtcttgtgaatttcacaggaataacactggaataaaagaactattgtgctcgctttgctatatgagaatgcactgccactttatttacagtaagtgtatttaagtgaaatttaaaggaatagtgtagctgtttaataacttgaatggtagatttatatttttacttgcaatttttttgtaggtcctgtgtctgatgatgagtcaccttctcctgattcaactacttcacttcctgaaattcaggcgcccgcacctgcaaacgtatgcaagcccattcctgtgaagcctaagcctgggaaacgccctgctgtggataagcttgaggacttgttggagggtggggatggacctttggaccttagtacccggaaactgccaaggcaatgagtgccctgcagctgtgtttatttaatgtgacgtcatgtaataaaattatgtcagctgctgagtgttttattacttgttgggtggggacttggatatataagtaggagcagatctgtgtggttagctcacagcaacctgctgccatccatggaggtttgggctatcttggaagacctcagacagactaggctactgctagaaaacgcctcggacggagtctctggcctttggagattctggttcggtggtgatctagctaggctagtgtttaggataaaacaggactacagggaagaatttgaaaagttattggacgacagtccaggactttttgaagctcttaacttgggtcatcaggctcattttaaggagaaggttttatcagttttagatttttctactcctggtagaactgctgctgctgtagcttttcttacttttatattggataaatggatccgccaaactcacttcagcaagggatacgttttggatttcatagcagcagctttgtggagaacatggaaggctcgcaggatgaggacaatcttagattactggccagtgcagcctctgggagtagcagggatactgagacacccaccgaccatgccagcggttctgcaggaggagcagcaggaggacaatccgagagccggcctggaccctccggtggaggagtagctgacctgtttcctgaactgcgacgggtgcttactaggtctacaaccagtggacagaacaggggcattaagagggagaggaatcctagtgggaacaattcaagaaccgagttggctttaagtttaatgagccgcaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacaatatagaattactaagaagattaatattagaaatgcatgctacatatcagggaatggggcagaggttataatagatacacaagataaagcagcttttagatgttgtatgatgggtatgtggccaggggttgtcggcatggaagcagtaacacttatgaatattaggtttagaggggatgggtataatggcattgtatttatggctaacactaagctgattctacatggttgtagcttttttgggtttaataatacgtgtgtagaagcttgggggcaagttagtgtgaggggttgtagtttttatgcatgctggattgcaacatcaggtagggtgaagagtcagttgtctgtaaagaaatgcatgtttgagagatgtaatcttggcatactgaatgaaggtgaagcaagggtccgccactgcgcggctacagaaactggctgcttcattctaataaagggaaatgccagtgtaaagcataatatgatctgtggacattcggatgagaggccttatcagatgctgacctgcgctggtggacattgcaatattcttgctaccgtgcatatcgtttcacatgcacgcaagaaatggcctgtatttgaacataatgtgattaccaagtgcaccatgcacataggtggtcgcaggggaatgtttatgccttaccagtgtaacatgaatcatgtgaaggtgatgttggaaccagatgccttttccagagtgagcttaacaggaatctttgatatgaatattcaactatggaagatcctgagatatgatgacactaaaccaagggtgcgcgcatgcgaatgcggaggcaagcatgctagattccagccggtgtgcgtggatgtgactgaagacctgagacccgatcatttggtgcttgcctgcactggagcggagtttggttctagtggtgaagaaactgactaaagtgagtagtggggcaagatgtggatggggactttcaggttggtaaggtggacaaattgggtaaattttgttaatttctgtcttgcagctgccatgagtggaagtgcttcttttgaggggggagtatttagcccttatctgacgggcaggctcccaccatgggcaggagttcgtcagaatgtcatgggatctactgtggatgggagacccgtccagcccgccaattcctcaacgctgacctatgccactttgagttcgtcaccattggatgcagctgcagccgccgccgctactgctgccgccaacaccatccttggaatgggctattacggaagcatcgttgccaattccagttcctctaataacccttcaaccctggctgaggacaagctacttgttctcttggctcagctcgaagccttaacccaacgcttaggcgaactgtctaagcaggtggcccagttgcgtgagcaaactgagtctgctgttgccacagtaaagtctaaataaagatctcaaatcaataaataaagaaatactgattataaaacaaatgaatgtttatttgatttttcgcgcgcggtatgccctggaccatcggtctcgatcattgagaactcggtggatcttttccagtaccctgtaaaggtgggattgaatgtttagatacatgggcattagtccgtctcgggggtggagatagctccattgaagagcctcttgctccggggtagtgttataaatcacccagtcatagcaaggtcggagtgcatggtgttgcacaatatcttttaggagcagactaattgcaacggggaggcccttagtgtaggtgtttacaaatctgttaagctgggacgggtgcattcggggtgaaattatatgcattttggactggatcttgaggttggcaatgttgccgcctagatcccgtctcgggttcatattgtgcaggaccaccaagacagtgtatcctgtgcacttgggaaatttatcatgcagcttagagggaaaagcatgaaaaaatttggagacgcctttgtgaccccccagattctccatgcactcatccataatgatagcgatggggccgtgggcagcggcacgggcgaacacgttgcgggggtctgaaacatcatagttatgctcctgagtcaggtcatcataagccattttaataaactttgggcggagggtgccagattggggaatgaaagttccctctggcccgggagcatagtttccctcacatatttgcatttcccaggctttcagttcagagggggggatcatgtccacctgcggggctataaaaaataccgtttctggagccggggtgattaactgggatgagagcaaattcctaagcagctgagacttgccgcacccagtgggaccgtaaatgaccccaattacgggttgcagatggtagtttagggagcgacagctgccgtcctcccggagcaggggggccacttcgttcatcatttgccttacatggatattttcccgcaccaagtccgttaggaggcgctctcccccaagggatagaagctcctggagcgaggagaagtttttcagcggctttagcccgtcagccatgggcattttggaaagagtctgttgcaaaagctcgagccggtcccagagctcggcgatgtgctctatggcatctcgatccagcagacctcctcgtttcgcgggttgggacggctcctggagtagggaatcagacgatgggcgtccagcgctgccagggtccgatccttccatggtcgcagcgtccgagttagggttgtttccgtcacggtgaaggggtgcgcgcctggttgggcgcttgcgagggtgcgcttcagactcatcctgctggtcgagaaccgctgccgatcggcgccctgcatgtcggccaggtagcagtttaccataagttcgtagttaagcgcctcggccgcgtggcctttggcacggagcttacctttggaagttttatggcaggcggggcagtagatacatttgagggcatacagcttgggcgcgaggaaaatggattcgggggagtatgcatccgcaccgcaggaggcgcagacggtttcgcactctacgagccaggtcagatccggctcatcggggtcaaaaacaagttttccgccatgttttttgatgcgtttcttacctttggtttccatgagttcgtgtccccgctgggtgacaaagaggctgtccgtgtccccgtagaccgactttatgggtctgtcctcgagcggagtgcctcggtcctcttcgtagaggaacccagcccactctgatacaaaagcgcgtgtccaggccagcacaaaggaggccacgtgggaggggtagcggtcgttgtcaaccagggggtccaccttctctacggtatgtaaacacatgtccccctcctccacatccaagaatgtgattggcttgtaagtgtaggccacgtgaccaggggtccccgccgggggggtataaaagggggcgggcctctgttcgtcctcactgtcttccggatcgctgtccaggagcgccagctgttggggtaggtattccctctcaaaggcgggcataacctctgcacttaggttgtcagtttctaggaacgaggaggatttgatattgacagtaccagcagagatgcctttcataagactctcgtccatctggtcagaaaacacaatcttctggttgtccagcttggtggcaaatgatccatagagggcattggatagaagcttggcgatggagcgcatggtttggttcttttccttgtccgcgcgctccttggcggcgatgttaagctggacgtactcgcgcgccacacatttccattcaggaaagatggttgtcagttcatccggaactattctgactcgccatcccctattgtgcagggttatcagatccacactggtggccacctcgcctcggaggggctcattggtccagcagagtcgacctccttttcttgaacagaaaggggggagggggtctagcatgagctcatcaggggggtccgcatctatggtaaatattcccggtagcaaatctttgtcaaaatagctaatggtggcgggatcatccaaggtcatctgccattctcgaactgccagcgcgcgctcataggggttaagaggggtgccccagggcatggggtgggtgagcgcggaggcatacatgccacagatatcgtagacatagagtggctcttcgaggatgccgatgtaagtgggataacagcgcccccctctgatgcttgctcgcacatagtcatagagttcatgtgagggggcgagaagactcgggcccagattggtgcggttgggtttttccgccctgtaaacgatctggcgaaagatggcatgggaattggaagagatagtaggtctctggaatatgttaaaatgggcatgaggtaagcctacagagtcccttatgaagtgggcatatgactcttgcagcttggctaccagctcggcggtgacaagtacatccagggcacagtagtcgagagtttcctggatgatgtcataacgcggttggcttttcttttcccacagctcgcggttaagaaggtattcttcgtgatccttccagtactcttcgaggggaaacccgtctttttctgcacggtaagagcccaacatgtagaactgattgactgccttgtagggacagcatcccttctccactgggagagagtatgcttgggctgcattgcgcagcgaggtatgagtgagggcaaaagtgtccctgaccatgactttaaggaattgatacttgaagtcgatgtcatcacaggccccctgttcccagagttggaagttcacccgcttcttgtaggcggggttgggcaaagcgaaagtaacatcattgaagaggatcttgccggccctgggcatgaaatttcgggtgattctgaaaggctgagggacctctgctcggttattaataacctgagcggccaaaactatctcatcaaagccgttgatgttgtgccccactatgtacagttctaagaatcgaggggtgcccctgacatgaggcagcttcttgagttcttcaaaagtgagatctgtagggtcagtgagagcatagtgttcgagggcccattcgtgcaggtgagggttcgctttgagaaaggaggaccataggtccactgctagtgctgtttgtaactggtcccggtactgacgaaaatgctgccccactgccatcttttctggggtgacgcaatagaaggtttgggggtcctgccgccagcggtcccacttgagtttcatggcgaggtcataggcgatgttgacaagccgctggtctccagagagtttcatgaccagcatgaaggggattagctgcttgccaaaggaccccatccaggtgtaggtttccacatcgtaggtgaggaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtaatcgcagcgattcacgggatgcacctcatgaatgagttgtacctgacttcctttgacgagaaatttcagtggaaaattgaggcctggcgcttgtaccttgcgctctactatgttgtctgcatcggcatgaccatcttctgtctcgatggtggtcatgctgacgagccctcgcgggaggcaagtccagacctcggcgcggcaggggcggagctcgaggacgagagcgcgcaggccggagatgtccagggtcctgagacgctgcggagtcaggttagtaggcagtgtcaggagattgacttgcatgatcttttccagggcgtgagggaggttcagatggtacttgatctccacgggtccgttggtggagatgtcgatggcttgcagggttccgtgccccttgggcgctaccaccgtgcccttgtttttccttttgggcggcggtggctctgttgcttcttgcatgtttagaagcggtgtcgagggcgcgcaccgggcggctcgggacccggcggcatggctggcagtggtacgtcggcgccgcgtgctggtaggttctggtactgtgccctgagaagacttgcatgcgcgacgacgcggcggttgacatcctggatctgacgcctctgggtgaaagctaccggccccgtgagcttgaacctgaaagagagttcaacagaatcaatctcggtatcattgacggcggcttgcctaaggatttcttgcacgtcgccagagttgtcctggtaggcgatatcggccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacagcccccacgggatctctcgcgcgcatgaccacctgggcgaggttgagctccacgtggcgggtgaagaccgcatagttgcataggcgctggaaaaggtagttgagtgtggtggcaatgtgctcggtgacaaagaaatacatgatccatcgtctcaacggcatctcgctgacatcgcccagcgcttccaagcgctccatggcctcgtagaagtccacggcaaagttgaaaaactgggagttacgcgcggacacggtcaactcctcttccaaaagacggacgagttcggcgatggtggtgcgcacctcgcgctcgaaagcccccgggatttcttcctcaatctcttcttcttccactaacatctcttcctcttcaggtggggctgcaggagcagggggaacgcggcgacgccggcggcgcacgggcagacggtcgatgaatctttcaatgacctctccgcggcggcggcgcatggtctcggtgacggcacgaccgttttccctgggtctcagagtgaagacgcctccgcgcatctccctgaagtggtgactgggaggctctccgttgggcagggacaccgcgctgattatgcattttattaattgccccgtaggtactccgcgcaaggacctgattgtctcaagatccacgggatctgaaaacctttcgacgaaagcgtctaaccagtcgcaatcgcaaggtaggctgagcactgtttcttgcgggcgggggcggctagacgctcggtcggggatctctctttcttctccttcctcctcttgggagggtaagacgatgctgctggtgatgaaattaaaataggcagttttaagacggcggatggtggcgaggagcaccaggtctttgggtccggcttgttggatgcgcaggcgatgggccattccccaagcattatcctgacatctggccagatctttatagtagtcttgcataagtcgttccacgggcacttcttcttcgcccgctctgccatgcatgcgagtaatcccgaacccgcgcatgggctggacaagtgccaggtccgctacaaccctttcggcgaggatggcttgctgcacctgggtaagggtggcttggaagtcgtcaaagtccacgaagcggtggtaggccccggtgttgattgtgtaggagcagttggccatgactgaccagttgactgtctggtgcccagggcgcacgagctcggtgtacttaagacgcgagtatgcgcgggtgtcaaagatgtaatcgttgcaggtgcgcaccaggtactggtagccgatgagaaagtgtggcggtggctggcggtacaggggccatcgctctgtagccggagctccgggggcgaggtcttccagcatgaggcggtggtagccgtagatgtacctggacatccaggtgataccggaggcggtggtggatgcacgtgggaactcgcgcacgcggttccagatgttgcgcagcggcatgaagtagttcatggtaggcacggtctggccagtaaggcgcgcgcagtcattgacgctctgtagacacggagaaaacgaaagcgatgagcggctcgactccgtggcctgggggaacgtgaacgggttgggtcgcggtgtaccccggttcgagtccaaagctaaataatcagactcggatcggccggagccgcggctaacgtggtattggctatcccgtctcgacccagccgacgaatatccagggtacggagtagagtcgtttttgctgctttgttgtttttcctggacgggtgccattgccacgtcaagctttagaacgctcagttctcgggccgtgagtggctcgcgcccatagtctggagaatcagccgccagggttgcgttgcggtatgccccggttcgagccaaagcgcggctcgtattggccggtttccgcaacaagcaaggtttggcagccccgtcatttccaagaccccgccagccgacttcaccagtttacgggagcgagcccttttttttttttgttttttgttgaccagatgcatccagtgctgcgacagatgcgcccccagcaacaggccccttctcagcaacagccacaaaaggctcttcttgctcctgcaactactgcagctgcagccgtgagcggcgcgggacagcccgcctatgatctggacttggaagagggcgagggattggcgcgcctgggggctccatcgcccgagcggcacccgcgggtgcaactaaaaaaggactctcgcgaggcgtacgtgccacagcagaacctgttcagggacaggagcggcgaggagccagaggagatgcgagcatctcgatttaacgcgggtcgcgagctgcgccacggtctggatcgaagacggctgctgcaagacgaggattttgaggtcgatgaagtgacagggatcagcccagctagggcacatgtggcagcggccaacctagtctcggcctacgagcagaccgtgaaggaggagcgcaacttccaaaaatcttttaacaaccatgtgcgcaccctgatcgcccgcgaggaagtgaccctgggtctgatgcacctgtgggacctgatggaggctatcacccagaaccccactagcaaacccctgacagctcagctgtttctggtggttcaacatagcagggacaacgaggcattcagggaggcgttgttgaacatcaccgagcctgatgggagatggctgtatgatctgatcaacatcctgcaaagtattatagtgcaggaacgtagcctgggtttggctgagaaagtggcagctatcaactactcggtcttgagcctgggcaaatactacgctcgcaagatctacaagaccccctacgtacccatagacaaggaggtaaagatagatgggttttacatgcgcatgactctcaaggtgctgactctgagcgacgatctgggggtgtatcgcaatgacaggatgcaccgtgcggtgagcgccagcaggaggcgcgagctgagcgacagagaacttatgcacagcttgcaaagagctctaacgggggctgggaccgatggggagaactactttgacatgggagcggacttgcaatggcaacccagtcgcagggccatggaggctgcagggtgtgagcttccttacatagaagaggtggatgaagtcgaggacgaggagggcgagtacttggaagactgatggcgcgacccgtatttttgctagatggaacagcagcaggcaccggaccccgcaatgcgggcggcgctgcagagccagccgtccggcattaactcctcggacgattggacccaggccatgcaacgcataatggcgctgacgacccgcaaccccgaagcctttagacagcaaccccaggccaaccgcctttcggctatactggaggccgtagtgccctcccgctccaaccccacccacgagaaggtcctggctatcgtgaacgcgctggtggagaacaaggccatccgtcccgatgaggccgggctggtatacaatgctctcttggagcgcgtggcccgttacaacagcagcaacgtgcagaccaacctggaccggatggtgaccgatgtgcgcgaggccgtgtctcagcgcgagcggttccagcgcgacgccaacttggggtcgttggtagcgctaaacgctttcctcagcacccagcccgctaacgtgccccgtggtcagcaagactatacaaactttttgagtgcattgagactcatggtagctgaggtgcctcagagcgaggtgtaccagtccgggccagattacttcttccagaccagcagacagggcttgcagacagtgaacctgactcaggctttcaagaacctgaagggtctctggggagtgcacgccccagtaggggatcgcgcgaccgtgtctagcttgctgactcccaactcccgcctgctgctgctgctggtatccccctttactgacagcggtagcatcgaccgcaactcctacttgggatacctgcttaacctgtatcgcgaggccataggacagagccaggtggacgaacagacctatcaagaaatcacccaagtgagccgcgccctgggtcaggaagacacgggcagtttggaagccaccctaaacttcttgttaaccaaccggtcgcagaagatccctcctcagtatgcgcttaccgctgaggaggagcggatcctcagatacgtgcaacagagcgttggactgttcctgatgcaggagggggcgacacctaccgccgcgctggacatgacagctcgaaacatggagcccagcatgtatgctagtaacaggcctttcattaacaaactgctggactacctgcacagggcggccgccatgaactctgattatttcaccaatgctatcctgaacccacactggctgcccccacctggtttctacactggcgagtacgacatgcccgaccccaatgacgggttcctgtgggacgatgtagacagcagcatattctccccgcctcccggttatacagtttggaagaaggaagggggcgatacaaggcactcttccgtgtcgctgtccagaacggctggtgctgccgcgaccgtgcccgaagctgcaagtcctttccctagcttgcccttttcactaaacagcgttcgcagcagtgaactggggagaataacccgcccgcgcttgatgggcgaggatgagtacttgaatgactctttgttgaggccagagagggaaaagaacttccccaacaatggaatagagagcctggtggataagatgagtagatggaagacctatgcgcaggatcacagagacgagcccaaaattttgggggctacaagcagaccgacccgtagacgccagcgccacgacaggcagatgggtcttgtgtgggacgatgaggactctgccgatgatagcagcgtgttggacttgggtggaagaggagggggcaacccgttcgctcatctgcgtcccagattcgggcgcatgttgtaaaagtgaaagtaaaataaaaagacaactcaccaaggccatggcgaccgagcgtgcgttcgttcttttttgttatctgtgtttagtacgatgaggagacgagccgtgctaggcggagcggtggtgtatccggagggtcctcctccttcttacgagagcgtgatgcagcaacaggcggcgatgctacagcccccactggaggctcccttcgtacccccgcggtacctggcacctacggaagggagaaacagcattcgttactcggagctgtcgcccctatacgataccaccaagttgtatctggtggacaacaagtcggcggacattgcctccctgaactatcagaacgaccacagcaacttcctgaccacggtggtgcagaacaatgactttacccccacggaggctagcacccagaccatcaactttgacgagcggtcgcgatggggcggtcagctgaagaccatcatgcacaccaacatgcccaacgtgaacgagtacatgttcagcaacaagttcaaggcgagggtgatggtgtccagaaaggctcctgaaggtgttatagtaaatgacacctatgatcataaagaggatatcttaaagtatgagtggtttgagttcactttaccagaaggcaacttctcagccaccatgaccattgacctgatgaacaatgccatcattgacaactacctggaaattggcagacaaaatggagtgctggaaagtgacattggtgttaagtttgacactagaaactttaggctcgggtgggaccccgaaactaagttgattatgccaggagtctacacttatgaggcattccatcctgacattgttttgctgcctggttgcggggtagactttactgaaagccgacttagcaacttgcttggcatcaggaaaagacatccattccaggagggtttcaaaatcatgtatgaagatcttgaagggggtaatattcctgcccttttggatgtcactgcctatgaggaaagcaaaaaggataccactactgaaacaaccacactggctgttgcagaggaaactagtgaagatgataatataactagaggagatacttatataactgaaaaacaaaaacgtgaagctgcagctgctgaagttaaaaaagagttaaagatccaacctctagaaaaagacagcaagagtagaagctacaatgtcttggaagacaaaatcaacacggcctaccgcagctggtacctgtcctacaattacggtaaccctgagaaaggaataaggtcttggacactgcttaccacttcagatgtcacctgtggggcagagcaggtctactggtcgctccctgacatgatgcaagacccagtcaccttccgctccacaagacaagtcaacaactacccagtggtgggtgcagagcttatgcccgtcttctcaaagagtttctacaatgagcaagccgtgtactctcagcagctccgacaggccacttcgctcacgcacgtcttcaaccgcttccctgagaaccagatccttatccgcccgccggcgcccacaattaccaccgtcagtgaaaacgttcctgctctcacagatcacgggaccctgccgttacgcagcagtatccggggagtccagcgcgtgaccgttactgacgccagacgccgcacctgtccctacgtttacaaggccctgggcatagtcgcgccgcgcgttctttcaagccgcactttctaaaaaaaaaaaaaaaatgtccattctcatctcgcccagtaataataccggttggggactatatgcgcccaccaagatgtatggaggcgcccgcatacgctctacccagcaccctgtgcgcgttcgcggtcatttccgcgctccatggggcgcactcaagggtcgtacccgcactcggaccacggtcgatgatgtgatcgaccaggtggtcgccgatgctcgtaattatactcctactgcgcctacatctactgtggatgcagttattgacagtgtggtggcagacgcccgcgcctatgctcgccggaagagccgaaggaggcgcattgccaggcgccacagggctactaccgccatgcgagctgcaaaagctattctgcggagggccaaacgtgtggggcgaagagccatgcttagagcggccagacgcgcggctttaggtgccagcagcggcaggtcccgcaggcgcgcggccacggcggcagcagcggccattgccaacatggcccaaccgcgaagaggcaatgtgtactgggtgcgtgatgccactaccggccagcgcgtgcccgtgcgcacccgcccccctcgcacttagaagatactgagcagtctccgatgttgtgtcccagcggcaagtatgtccaagcgcaaatacaaggaagagatgctccaggtcatcgcgcctgaaatctacggtccaccggtgaaggatgaaaaaaagccccgcaaaatcaagcgggtcaaaaataacaaaaaggaagaagatgacgatgatgggctggtggagtttgtgcgcgagttcgccccaagacggcgcgtgcagtggcgcgggcgcaaagtgcgtcaagtgctcagacccggaaccactgtggtttttacacctggcgagcgttccagcactacttttaaacggtcctatgatgaggtgtacggggatgacgatattcttgagcaggcggcagaccgccttgatgagtttgcttatggcaagcgcactagatccagtcccaaagaggaggctgtgtccattcccttggatcatggaaatcccacccccagcctcaaaccagtcaccttgcagcaagtgctgcccgtgcctgcgcggagaggcgtaaagcgcgagggtgaggacctatatcctaccatgcagctaatggtgcccaagcgccagaggctagaagacgtactggagaaaatgaaagtggatccagatatccagcctgaggtcaaagtaagacctatcaaggaagtggcgccaggtttgggagtacaaaccttcgacatcaagattcccaccgagtccatggaagtgcagaccgaaccttcaaaacccacaaccacctcaattgaggtgcaaacggaaccctggacgcccgcgcccgttgtcgcccccagcaccactcgaagatcacgacgaaagtacggcccagcaagtcttctaatgcccaactatgctctgcacccatccatcattcccactccgggttacagaggcactcgctactatcgaaaccggagcaacacctctcgccgccgcaaaccacctgcaagtcgcactcgcagtcgccgccgccgcaacactgccagcaaagtgactcccgccgccctggtgcggagagtgtaccgcgatggtcgcgctgaacctctgacgctgccgcgcgcgcgctaccatccaagcatcaccacttaatgactgttgacgctgcctccttgcagatatggccctcacttgccgccttcgcgtccccattactggctaccgaggaagaaactcgcgccgtagaaggatgttggggcgagggatgcgccgccacagacgaaggcgcgctatcagcagacgattagggggtggctttttgccagctcttatacccatcatcgccgcagcgatcggggcgataccaggcatagcttccgtggcggttcaggcctcgcagcgccactaacattggaaaaaacttataaataaaaaatagaatggactctgacgctcctggtcctgtgactatgtttttgtagagatggaagacatcaatttttcatccctggctccgcgacacggcacgaggccgtacatgggcacctggagcgacatcggcacgagccaactgaacgggggcgccttcaattggagcagtatctggagcgggcttaaaaattttggctcgaccgtaaaaacctatgggaacaaagcttggaacagcagcacagggcaggctctaagaaataagcttaaggaacaaaacttccaacagaaggtggtcgatgggatcgcctctggtattaacggcgtagtggatttgaccaaccaggctgtacaaaaacagataaacagccgcctggacccgccgcccgcaacccctggtgaaatggaagtggaggaagaacttcctccgctggaaaagcggggcgacaagcgtccgcgacccgagctggagcagacgctggtgacgcgcgcagacgagcccccttcatacgaggaggcagtaaagctcggaatgcccactaccaggcctgtagctcacatggctaccggggtgatgaaaccttctcagacacatcgacccgccaccttggacttgcctcctccccctgcttctgcggcacctgttcccaaacctgtcgctaccagaaagcccaccgccgtacagcccgtcgccgtagccagaccgcgtcctgggggcacaccgcgcccgaaagcaaactggcaaagtactctgaacagcatcgtgggtctgggcgtgcagagtgtaaagcgccgtcgctgctattaattaaatatggagtagcgcttaacttgcttgtctgtgtgtatgtatcatcaccacgccgccgcagcagaggagaaaggaagaggtcgcgcgccgaggctgagttgctttcaagatggccaccccatcgatgatgccccaatgggcatacatgcacatcgccggacaggatgcttcggagtacctgagtccgggtctggtgcagttcgcccgtgcaacagacacctacttcagtatggggaacaaatttagaaaccccacagtggcgcccacccacgatgtgaccaccgatcgtagccagcgcctgatgctgcgcttcgtgcccgttgaccgggaagacaatacctactcttacaaagttcgctacacgctggctgtaggcgacaacagagtgcttgacatggccagcacattctttgacattcggggggtgcttgatagaggtcctagcttcaagccatattccggcacagcttacaattcactcgctcctaagggcgcgcccaatacatctcagtggatagttacaacgaatcgagacaatgcagtaactaccaccacaaacacatttggcattgcttccatgaagggagacaatattactaaagaaggtttgcaaattgggaaagacattaccactactgaaggagaagaaaagcccatttatgccgataaaacatatcagccagagcctcaagttggagaagaatcatggactgatactgatgtaacaaatgaaaagtttggtggaagagcccttaaaccagctaccaacatgaagccatgctacgggtcttttgcaagacctacaaacataaaagggggccaagctaaaaacagaaaagtaaaaccaacaaccgaaggaggggttgaaactgaggaaccagatattgatatggaatttttcgatggtagagatgctgttgcaggagctttagcgcctgaaattgtgctttatacggaaaatgtaaatttggaaactccagacagtcatgtggtatataaaccaggaacgtctgataactctcatgcaaatttgggtcaacaagccatgcctaacagacccaattacattggattcagggataactttgtaggcctaatgtactacaacagtactggaaatatgggagttttggctggccaagcatcacaactgaatgcagtggttgacttgcaggacagaaatactgaactgtcatatcagcttttgcttgattctctgggagacagaaccagatacttcagcatgtggaatcaggctgtggacagttacgatcccgatgttcgcattattgaaaatcatggcatcgaggatgaactgcctaattactgttttcctctggatggcataggaccagggaacaggtatcaaggcattaaagttaaaaccgatgacactaatggatgggaaaaagatgctaatgttgctacagctaatgaaatagccataggaaacaacctggctatggaaattaatatccaagctaacctttggagaagttttctgtactccaatgtggctttgtaccttccagatgtttacaagtacacgccacctaacattactttgcccactaacaccaacacctatgagtacatgaacgggcgagtggtatccccatctctggttgattcatacatcaacatcggcgccaggtggtctcttgacccaatggacaatgtgaatccattcaaccaccaccgcaatgctggtctgcgctacaggtccatgcttctgggaaatggtcgttatgtgcctttccacatacaagtgcctcaaaaattctttgctgtcaaaaacctacttcttctacctggctcctacacctacgagtggaactttagaaaggatgtgaacatggtcctgcaaagttcccttggaaatgacctcagaacagatggtgctaccataagtttcaccagcatcaatctctatgccaccttcttccccatggctcacaacacagcttccacccttgaagccatgctgcgcaacgataccaatgatcagtcatttaacgactacctctctgcagctaacatgctttaccccattcctgccaatgcaaccaacattccaatttccatcccatctcgcaactgggcagccttcaggggctggtccttcaccaggctcaaaaccaaggagactccatctcttggatcagggtttgatccttacttcgtatattctggatctattccctacctggatggcaccttctaccttaaccacactttcaagaaggtctccatcatgtttgactcctcagtcagctggcctggcaatgacaggctgttgagcccaaatgagtttgaaatcaagcgcactgtggacggggaaggatacaacgtggcacaatgcaacatgaccaaagactggttcctagttcagatgcttgccaactacaacattggctaccagggcttttacatccctgagggatacaaggatcgcatgtactcttttttcagaaacttccagcctatgagcaggcaggtggttgatgaggttaattacactgactacaaagccgtcaccttaccataccaacacaacaactctggctttgtagggtaccttgcacctactatgagacaaggggaaccttacccagccaattatccatacccgctcatcggaactactgccgttaagagtgttacccagaaaaagttcctgtgcgacaggaccatgtggcgcattcccttctccagcaacttcatgtccatgggggcccttaccgacctgggacagaacatgctctatgccaactcagcccatgcgctggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataagaagcctcttgcttcttgcaagcagcagctgcagccatgacatgcgggtccggaaacggctccagcgagcaagagctcaaagccatcgtccgagacctgggctgcggaccctatttcctgggaacctttgacaagcgtttcccggggttcatggcccccgacaagctcgcctgcgccatagtcaacactgccggacgcgagacggggggagagcactggctggcttttggttggaacccgcgctacaacacctgctacctttttgatccttttgggttctcggatgagcggcttaaacagatttaccagtttgagtacgaggggctcctgcgtcgcagtgcccttgctaccaaagaccgctgcatcaccctggaaaagtccacccaaagcgtgcagggtccgcgctcagccgcctgtggacttttttgctgtatgttccttcatgcctttgtgcactggcccgaccgccccatggacggaaaccccaccatgaagttgctgactggggtgtccaacagcatgctccaatcaccccaagtccagcccaccttgcgccgcaaccaggaggtgctataccgcttcctaaacacccactcatcttactttcgttctcaccgcgcgcgcatcgaaagggccaccgcgtttgaccgtatggatatgcaataagtcatgtaaaaccgtgtttaataaacagcactttatttttacatgcactgaggctctggttttgcttatttgtttcatcatttcacttagaagtcgaatggattctggcgggagtcagagtgacccgcgggcagggatacgttgcggaactgtaacctattctgccacttgaactcggggattactagcttgggaactggaatttcgggaaatgtgtcttgccacaactttctggtcagttgcatagcgccaagcaggtcaggagcagagatcttgaaatcacagttggggccggcattctggacacgggagttgcggtacactgggttgcaacactggaacaccatcaacgctgggtgtcttacgcttgccaacacggttgggtcactgatggtagtcacatccaagtcttcagcattggccatcccaaagggggtcatcttacatgtctgcctgcccatcacgggagcgcagcctggcttgtggttgcaatcacaatgaatggggatcagcatcatcctggcttggttgggagttatccctgggtacacagccttcatgaaggcttcgtactgcttaaaagcttcctgggccttacttccctcggtgtagaacatcccacaggacttactggaaaattgattagtagtacagttggcatcattcacacagcagcgggcatcgttgttggccaactgaaccacatttctgccccagcggttttgggtgatcttggctctgtctggattctccttcatagcgcgttgcccgttctcgctcgccacatccatctcaataatgtggtccttctggatcatgatagtgccatgcaggcatttcaccttgccttcataatcggtgcatccatgagcccacagagcgcacccggtgcactcccaattattgtgggcgatctcggaataataatgtaccaatccctgcatgaatcttcccatcattgttgtcaaggtcttcatgctggtaaatgtcagcgggatgccacggtgctcctcgttcacatactggtggcagatacgcttgtattgctcgtgctgctctggcatcagcttgaaagaggttctcagatcattatccagcctgtacctttccattagcacagccatcacttccatgcccttctcccaggcagataccaggggcagactcaaaggattcctaacagcaataaaagtagctcctttagctatagggtcattcttgtcgatcttctcaacacttctcttgccatccttctcaatgatgcgcaccggggggtagctgaagcccacggccaccaactgagcctgttctctttcttcttcactatcctgactgatgtcttgcagagggacatgcttggtcttcctgggcttcttcttgggagggatcgggggaggactgttgctccgctccggagacagggatgactgcgacgtttcgcttaccaataccacctggctctcggtagaagaaccggaccccacgcgacggtaggtgttcctcttcgggggcagaggtggaggcgactgagatgggctgcctggccttggaggcggatggctggcagagcccattccgcgttcgggggtgtgctcccggtggcggtcgcttgactgatttcctccgcggctggccattgtgttctcctaggcagagaaacaacagacatggaaactcagccatcactgccaacatcgctacacctcgcccccagcagcgacgaggaggagagcttaaccaccccaccacccagtcccgctaccaccacctctaccctcgatgatgaggaggaggtcaacgcagcccaggagatgcaggcgcaggataatgtgaaaacggaagagattgaggcagatgtcgagcaggacccgggctatgtgacgccggcggagcacgaggaggagctgaaacgctttctagacagagaggatgacgaccgcccagagcatcaagcaaatggcgtttaccagaaggctgggatcagggatcatgtcgccgactacctcaccggccttggtggggaggacgtgctcctcaaacatctagcaaggcagtcgatcatagttaaagacgcattgctcaatctcactgaagtgcccatcagtgtggaagagctcagccgcgcctacgagctgaacctcttttcgcctcaggtaccccccaagcggcagccaaacggcacctgcgaggccaaccctcgactcaacttctatccagcttttactatccccgaagtgttggccacctaccacatcttttttaagaaccaaaagattccagtctcctgccgcgccaaccgcacccgcgccgatgccctgctcaacttgggtccgggagctcgcttacctgatatagcttccttggaagaggttccaaagatctttgagggtctgggaagtgatgagacacgggccgcaaatgctctgcaacagggagagaatgacatggatgaacatcacagcgctctggtggaactggagggtgacaatgcccggattgcagtgctcaagcgcagtatcgtggtcacccattttgcctaccccgctgttaacctgccccccaaagttatgagcgctgtcatggaccatctgctcatcaaacgagcaagacccctttcagaaaaccagaacatgcaggatccagacgcctcggacgagggcaagccggtagtcagtgacgagcagctatctcgctggctgagtaccaactccccccgagatttggaagagaggcgcaagcttatgatggctgtagtgctagtaactgtggagctggagtgtctgcgccgctttttcaccgaccctgagaccctgcgcaagctagaggagaacctgcactacacctttagacatggcttcgtgcggcaggcatgcaagatctccaacgtggagcttaccaaccttgtttcttacatgggcattttgcatgagaaccgactagggcagagcgtcctgcacaccacccttaaaggggaggcccgccgtgactacatccgagactgtgtctacctctacctctgtcatacctggcagactggtatgggtgtgtggcaacagtgtttggaagagcagaacctgaaagagctgaacaagctcttgcagagatccctcaaagccctgtggacaggttttgatgagcgcaccgtcgcctcggacctggcagacatcatcttccccgagcgtctcagggttactctgcgaaacggcctgccagactttatgagccagagcatgcttaacaactttcgctctttcatcctggaacgctccggtatcctgcctgccacctgctgtgcgctgccctccgactttgtgcctctcacctaccgcgagtgtccaccgccgctatggagccactgctacctgttccgcctggccaactacctctcctaccactcggatgttatagaggatgtgagcggagacggcctgctggaatgccactgccgctgcaatctttgcacaccccaccgctcccttgcctgcaacccccagttgctgagcgagacccagattatcggcaccttcgagttgcagggtcccagcagtgaaggcgaggggtcttctccggggcagagtctgaaactgacaccggggctgtggacctccgcctacctgcgcaagtttcaccccgaggactaccatccctatgagatcaggttctatgaggaccaatcacatcctcccaaagtcgagctctcagcctgcgtcatcacccagggagcaattctagcccaattgcaagccatccaaaaatctcgccaagaatttctgctgaaaaagggaaacggggtctaccttgaccctcagaccggtgaggagcttaacacaagattcccccaggatgtcccatcgccgaggaagcaagaagctgaaagtgcagctgtcgcccccagagaatatggaggaagactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggggcccagcggcggcccaacagtagatgggacgagaccgggcgattcccaaacccgaccaccgcttccaagaccggtaagaaggagcgacagggatacaagtcctggcgtagacataaaaacgctatcatctcctgcttgcatgaatgcgggggcaacatatccttcacccggcgatacctgcttttcaaccacggtgtaaacttcccccgcaatatcttgcattactaccgtcacctccacagcccctactgcagtcagcaagtcccggcaaccccaacagaaaaatacagcagcgacaacggtgaccagaaaaccagcagttagaaaatccacaacaagtgcagcaggaggaggactgaggatcacagcgaacgagccagcgcagaccagagagctgaggaaccggatctttccaaccctctatgccattttccagcagagtcgggggcaagagcaggaactgaaagtaaaaaaccgatctctgcgctcgctcaccagaagttgtttgtatcacaagagcgaagaccaacttcagcgcactcttgaggacgccgaggctctcttcaacaagtactgcgcgctgactcttaaagagtagcccttgcccgcgctcattcgaaaacggcgggaatcacgtcacccttggcacctgtcctttgccctcgtcatgagtaaagagattcccacaccttacatgtggagctatcagccccaaatggggttggcagcaggcgcttcccaggactactccacccgcatgaattggcttagcgccgggccctcaatgatatcacgggttaatgatatacgagcttatcgaaaccagttactcctagaacagtcagctctcaccaccacaccccgtcaacaccttaatccccgaaattggcccgccaccctggtgtaccaggaaaatcccgctcccaccaccgtactacttcctcgagacgcccaggccgaagttcagatgactaacgcaggtgtacagctggcgggcggttccgccctatgtcgtcaccgacctcaacagagtataaaacgcctggtgatcagaggccgaggtattcagctcaacgacgagtcggttagctcttcgcttggtctgcgaccagacggagttttccagatcgccggctgtgggagatcttccttcactcctcgtcaggctgtgctaactttggagagttcgtcttcgcagccccgctcaggcggcattggaactctccagtttgtggaggagtttactccctctgtctactttaaccccttctccggctctcctggccagtacccggacgagtttataccgaacttcgacgcaatcagcgagtcagtggatggctatgattaatgtctaatggtggtgcggctgagctagctcgactgcgacacctagaccactgccgccgctttcgctgcttcgcccgggaactcaccgagttcatctacttcgaactcttcgaggagcaccctcagggtccggcccacggagtgcggattaccatcgaagggggaatagactctcgcctgcatcgcatcttctcccagcggcccgtgctgattgaacgcgaccagggaaatacaaccatctccatctactgcatctgtaaccaccccggattgcatgaaagcctttgctgtcttgtttgtgctgagtttaataaaaactgagttaagaccctcctacggactaccgcttcttcaatcaggactttacaacaccaaccagatcttccagaagacccagacccttcctcctttgatccaggactctaactttaccttgccagcaccctccactactaaccttcccgaaacaaacaagcttgcatctcatctgcaacaccgccttttacgaagccttctttctgccaatactaccactcccaaaaccggaggtgagctccgcggtcttcctactgacgacccctgggtggtagcgggttttgtaacgttaggagtagttgcgggtgggcttgtgctgatcctttgctacctatacacaccttgctgtgcatatttagtcatattgtgctgttggtttaagaaatgggggccatactagttgtgcttgctttactttcgcttttgggtctgggctctgctaatgtcaatcctcttgatcacgatccatgtctagacttcgacccagaaaactgcacacttacttttgcacccgacacaagccgtctctgtggagttcttattaagtgcggatgggactgcaggttcgttgaaattacacataataacaaaacatggaacaataccttatccaccacatgggagccaggagttcccgagtggtatactgtctctgtccgaggtcctgacggttccatccgcattagtaacaacactttcattttttctgaaatgtgcgatctggccatgttcatgagcagacagtatgacctatggcctcccagcaaagagaacattgtggcattttccattgcttattgcttggtaacatgcatcatcactgctatcatttgtgtgtgcatacacttgcttatagttattcgccctagacaaagcaatgaggaaaaagagaaaatgccttaacctttttcctcataccttttctttacagcatggcttctgttacagctctaattattgccagcattgtcactgtcgttcacgggcaaacaattgtccatattaccttaggacataatcacactcttgtagggcccccaattacttcagaggttatttggaccaaacttggaagtgttgattattttgatataatttgcaacaaaactaaaccaatatttgtaatctgtaacagacaaaatctcacgttaattaatgttagcaaaatttataacggttactattatggttatgacagatccagtagtcaatataaaaattacttagttcgcataactcagcccaaattaacagtgccaactatgacaataattaaaatggctaataaagcattagaaaattttacatcaccaacaacgcccaatgaaaaaaacattccaaattcaatgattgcaattattgcggcggtggcattgggaatggcactaataataatatgcatgttcctatatgcttgttgctataaaaagtttcaacataaacaggatccactactaaattttaacatttaattttttatacagatgatttccactacaatttttatcattattagccttgcagctgtaacttatggccgttcacacctaactgtacctgttggctcaacatgtacactacaaggaccccaagaaggctatgtcacttggtggagaatatatgataatggagggttcgctagaccatgtgatcagcctggtacaaaattttcatgcaacggaagagacttgaccattattaatataacatcaaatgagcaaggcttctattatggaaccaactataaaaatagtttagattacaacattattgtagtgccagccaccacgtctgctccccgcaaatccactttctctagcagcagtgccaaagcaagcacaattcctaaaacagcttctgctattttaaagcttccaaaaatcgctttaagtaattccacagccgctcccaatacaattcctaaatcaacaattggcatcattactgccgtggtagtgggattaatgattatatttttgtgcataacgtactacgcctgctgctatagaaaacatgaacaaaaaggtgatgcattactaaattttgatgtttaatttttttatagaattattatattgtctcaatcaaataccactaacactatcaatgtgcagactactttaaatcatgacatggaaaaccacactacctcctatgcatacccaatgttcatagaaattctaaaagacgtcccatctattcttctatgattagtcgtccccatatggctctgaatgaaatctaagatcttttttttttctcttacagtatggtgaacatcaatcatgatccctagaaatttcttcttcaccatactcatctgtgctttcaatgtctgtgctactttcacagcagtagccactgcaagcccagactgtataggaccatttgcttcctatgcactttttgccttcgttacttgcatctgcgtgtgtagcatagtctgcctggttattaattttttccaactggtagactggatctttgtgcgaattgcctacctacgtcaccatcccgaataccgcaatcaaaatgttgcggcacttcttaggcttatttaaaaccatgcaggctatgctaccagtcattttaattctgctactaccctgcattgccctagcttccaccgccactcgcgctacacctgaacaacttagaaaatgcaaatttcaacaaccatggtcatttcttgattgctaccatgaaaaatctgattttcccacatactggatagtgattgttggaataattaacatactttcatgtacctttttctcaatcacaatataccccacatttaattttgggtggaattctcccaatgcactgggttacccacaagaaccaaatgaacatatcccactacaacacgtacaacaaccactagcacttgtagagtatgaaaatgagccacaaccttcactgccccctgccattagttacttcaacctaaccggcggagatgactgacccaatcgccacatcatccaccgctgccaaggagctgctggacatggacggacgtgcctcagaacagcgactcatccaactacgcattcgtcagcagcaggaacgagcagtaaaagagctaagggatgccattgggattcaccagtgcaaaaaaggcatattctgcttagtaaaacaatccaaaatctcctacgagatcaccgctactgaccatcgtctctcatacgagctcggtccgcagcgacaaaaattcacctgcatggtgggaatcaaccccatagttatcacccagcagtctggagatactaagggttgcatccactgttcctgtgattccaccgagtgcatctacacactgctgaagaccctctgcggccttcgagacctcctacccatgaactaatcattgcccctaccttacccaatccaaatattaataaagacacttacttgaaatcagcaatacagtctttgtcaaaactttctaccagcagcacctcaccctcttcccaactctggtactctaaacgtcggagggtggcatactttctccacactttgaaagggatgtcaaattttatttcctcttctttgcccacaatcttcatttctttatccccagatggccaagcgagctcggctaagcacttccttcaacccggtgtacccttatgaagatgaaagcaacttacaacacccatttataaatcctggtttcatttcccctgacgggttcacacaaagtccaaacggggttttaagtcttaaatgtgttaatccacttaccactgcaagcggctcgctccaacttaaagtgggaagtggtcttacagtagacactactgatggatccttagaagaaaacatcaaagttaacacccccctaacaaagtcaaaccattctataaatttaccaataggaaacggtttgcaaatagaacaaaacaaactttgcagtaagctcggaaatggtcttacatttgactcttccaattctattgcactcaaaaataacactttatggacaggtccaaaaccagaagccaactgcataattgaatacgggaaagaaaacccagatagcaaactaactttaatccttgtaaaaaatggaggaattgttaatggatatgtaacgctaatgggagcctcagactatgttaacaccttatttaaaaacaaaaatgtctccattaatgtagaattatactttgatgccactggtcatatattaccagacttatcttctcttaaaacagatttacaactaaaatacaagcaaaccactcactttagtgcaagaggttttatgccaagtactacagcgtatccatttgtccttcctaatgcgggaacagataatgaaaattatatttttggtcaatgctactataaagcaagcgatggtgccctttttccgttggaagttactgttacgcttaataaacgcctgccagatagtcgcacatcctatgttatgacttttttatggtccttgaatgctggtctagctccagaaactactcaggcaaccctcataacctccccatttaccttttcctatattacagaagatgactgacaacaaaaataaagttcaacattttttattgaaattccttttacagtattcgagtagttattttgcctcccccttcccatttaacagaatacaccaatctctccccacgcacagctttaaacatttggataccattagagatagacatagttttagattccacattccaaacagtttcagagcgagccaatctggggtcagtgatacataaaaatgcatcgggatagtcttttaaagcgctttcacagtccaactgttgtggatgcgactccggagtctgaatcacggtcatctggaagaagaacgatgggaatcataatccgaaaacggaatcgggcgattgtgtctcatcaaccccacaagcagccgctgtctgcgtcgctccgtgcgactgctgtttatgggatcggggtccgcagtgtcctgaagcatgattttaatagcccttaacattaactttctggtgcgatgcgcgcagcaacgcattctaatttcacttagattactacagtaggtacagcacattatcacaatattgtttaataaaccataattaaaagcgctccagccaaaactcatatctgatataatcgcccctgcatgaccatcataccaaagtttaatataaattaaatgtcgttccctcaaaaacacactacccacatacataatctcttttggcatgtgcatattaacaatttgtctgtaccatggacaacgttggttaatcatgcaacccaatataaccttccggaaccacactgccaacaccgctcccccagccatgcattgaagtgaaccctgctgattacaatgacaatgaagaacccaattctctcgaccatgaatcacttgagactgaaaaatatctatagtagcacaacaaagacataaatgcatgcatcttttcataatttttaactcctctggatttaaaaacatatcccaaggaatgggaaactcttgcagaacagtaaagctggcagaacaaggaagaccacgaacacaacttacactatgcatagtcatagtatcacaatctggcaacagcgggtggtcttcagtcatagaagctcgggtttcattttcctcacatcgtggtaactgggctctggtgtaagggtgatgtctggcgcatgatgtggagcgtgcgtgcaaccttgtcataatggagttgcttcctgacattctcgtattttgtatagcaaaacgcggccctggcacaacacactcttcttcgtcttctatcctgccgcttagtgtgttccgtctgataattcaagtacagccacacttttaagttggtcaaaagaatgctggcttcagttgtaattaaaactccatcatatttaattgatctaaggaaatcatccacggtagcatatgcaaatcccaaccaagcaatgcaactggattgcgtttcaagcagcagaggagagggaagagacggaagaatcatgttaatttttattccaaacgatctcgcagtacttcaaattgtagatcgcgcagatggcatctatcgcccccactgtgttggtgaaaaagcacagctaaatcaaaagaaatgcgattttcaaggtgctcaacggtggcttccaacaaagcctccacgcgcacatccaaaaacaaaagaataccaaaagaaggagcattttctaactcctcaaacatcatattacattcctgcaccattcccagataattttcagctttccagccttcaattattcgtgtcagttcttgtggtaaatccaaaccacacattacaaacaggtcccggagggcgccctccaccaccattcttaaacacaccctcataatgacaaaatatcttgctcctgtgtcacctgtagcaaattaagaatggcatcatcaattgacatgcccttggctctaagttcttctctaagttctagttgtagatactctctcatattatcaccaaactgcttagccagaagccccccgggaacaatagcaggggacgctacagtgcagtacaagcgcagacctccccaattggctccagcaaaaacaagattagaataagcatactggcaaccaccagtaatatcatcaaagttgctggaaatataatcaggcagagtttcttgtaaaaattgaataaaagaaaaattttccaaaaaaacattcaaaacctctgggatgcaaatgcaataggttaccgcgctgcgctccaacattgttagttttgaattagtctgcaaaataaaagaaacaagcgtcatatcatagtagcctgtcgaacaggtggaaaaatcagtctttccatcacaagacaagccacagggtctccagctctaccctcgtaaaacctgtcatcgtgattaaacaacagcaccgaaagttcctcgcggtggccagcatgaataattcttgatgaagcatataatccagacatgttagcatcagttaaagagaaaaaacagccaacatagcctctgggtataattatgcttaatcttaagtatagcaaagccacccctcgcggatacaaagtaaaaggcacaggagaataaaaaatataattatttctctgctgctgttcaggcaacgtcgcccccggtccctctaaatacacatacaaagcctcattagccatggcttaccaggcaaagtacagccaacgcgcaaagcacaagctctaaagaagctctaaaaacactctccaacctctccacaatatatacacaagccctaaactgacgtaatgagagtaaagtgtaaaaaatcccgccaaacccaacacacaccccgaaactgcgtcagcagggaaaagtacagtttcacttccgcaatcccaacaagcgtaacttcctctttctcacgatacgtcacatccgattaacttacaacgtcattttcccacggtcacaccgccccgtttagccgttcaccccgcagccaatcaccgcacagcgcgcacttttttaaattacctcatttgcatattggcaccattccatctataaggtatattattgatgatg

SEQ ID NO: 577 - DNA, 35990 bp, ATCC#VR-4, strain RI-67
ctatctatataatataccttattttttttgtgtgagttaatatgcaaataaggcgtgaaaatttggggatggggcgcgctgattggctgtgacagcggcgttcgttaggggcggggcaggtgacgttttgatgacgcgactatgaggaggagttagtttgcaagttctggtggggaaaagtgacgtcaaacgaggtgtggtttaaacacggaaatactcaattttcccacgctgtctaacaggaaatgaggtgtttttgggcggatgcaagtgaaaacggaccattttcgcgcgaaaactgaatgaggaagtgaaatctgagtaatttagtgtttatgacagggaggagtatttgccgagggccgagtagactttgaccgtttacgtgggggtttcgattaccgtgtttttcacctaaagttccgcgtacggtgtcaaagtccggtgtttttacgtaggtgtcagctgatcgtcagggtatttaaacctgcgctctgcagtcaagaggccactcttgagtgccagcgagaagagttttctcctccgcgccgcgagtcagatctacactttgaaatatgaggcacctaagagacctgcccgatgaggaaattatcatcgcttccgggagcgagattctggaactggtggtaaatgctatgatgggcgacgaccatccggaaccccccaccccatttgagacaccttcgctgcacgatttgtatgatctggaggtggatgtgcccgaggacgaccccaacgagaaggcggtaaatgatttatttagcgatgccgcgctgctagctgccgaggaggcttcaagccctagctcagacagcgactcttcactgcatacccctagacacgacagaggtgagaaagagatccccgggcttaaatgggaaaagatggacttgcgttgctatgaggaatgcctgcccccaagcgatgatgaggacgagcaggcgattcagaacgcagcgagccatggagtgcaagccgtcagcgagagctttgcactggactgcccgcctttgcccggacacggctgtaagtcttgtgaatttcatcgcatcaatactggagataaagctgtgttatgtgcactttgctatatgagagcgtacaaccattgtgtttacagtaagtgtgattaagtgaactttaaagggaggcaaagagtagggtgactgggtgatgactggtttatttatgtatatctgttttttatataggtcccgtttctgacgcagatgatgagacccccactacagagtccactttgtcaccccctgaaattggcacgtctccatctgacaatattgttagaccagttcctgtaagagccactgggaggagagcagctgtagaatgtttggatgatttgcttcagggtggagatgaacctttggacttgtgtacccggaaacgccccaggcattaagtgccacacatgtgtgtttacttgaggtgatgtcagtatttatagggtgtggagtgcaataaaatatgtgttgactttaagtgcgtggtttatgactcaggggaggggactttgggtatataagcaggtgcagacctgtgtggttagctcagagcggtatggagatttggacggttttggaagactttcacaagactaggcagctgctagagaacgcctcgaacggagtctcttacctgtggagattctgcttcggcggtgacctagctaagctagtctatagggccaaacaggattatagggaacaatttgaggatattttgagagagtgtcctggtctttttgacgctcttaacttgggccatcagtctcactttaaccagagaatttcaagagcccttgactttactactcctggcagaaccactgcagcagtagccttttttgcttttatttttgacaaatggagtcaagaaacccatttcagcagggattaccagctggatttcttagcagtagctttgtggagaacatggaagtgccagcgcctgaatgcaatctccggctacttgccggtacagccgctagacactctgaggatcctgagtctccagcagcaggaggatcaagaagagaatccgagagccggcctggaccctccggcggaggagtagctgacctgtttcctgaactgcaccgggtgctgactaggtcttcgagtggtcgggagaggggtattaagcgggagaggcatgatgagactaatcacagaattgaactgactgtgggtctgatgagccgcaagcgtccagaaacagtgtggtggtatgaggtgcagtcaactggcacagatgaggtgtcagtcatgcatgagagattttccctagaacaagtcaagacttgttggttggagcctgaggatgattgggaggtagccatcaggaattatgccaagctggctctgaggccagatagaaagtacaagattactaagctgataaatatcagaaatgcctgctacatctcagggaatggggctgaagtggagatctgtctccaggatagagtggctttcagatgctgcatgatgaatatgtacccgggagtggtggacatggatggggtcacctttatgaacatgaggttcaggggagatgggtataatgggacggtctttatggccaataccaagctgacagtgcatggatgctccttctttgggtttaataacacctgcatcgaggcttggggtcaggtcggtgttaaggggtgcagtttttcagccaactggatgggggtagtgggcaggaccaagagtatgctgtctgtgaagaaatgcttgtttgagaggtgccacctgggggtgatgagcgagggcgaagccagaatccgccactgtgcctctaccgagacgggctgttttgtgctgtgcaagggcaatgccaagatcaagcataatatgatctgtggagcctcggacgagcgcggctaccagatgctgacctgcgccggtgggaacagtcatatgctggccgccgtgcatgtggcttcccattcccgcaagccctggcctgagttcgagcacaatgtcatgaccaggtgcaatatgcatctgggggctcgccgaggcatgtttatgccctaccagtgcaacctgaattatgtaaaggtgctcctggagcccgatgtcatgtccagagtgagcctgacgggggtgtttgacatgaatgtggaagtgtggaagattctaagatatgatgaatacaagaccaggtgtcgagcctgcgagtgcggagggaagcatgccaggttccagcccgtgtgtgtggatgtgacggaggacctgcgacccgatcatttggtgttgtcctgcaccgggacggagttcggctccagtggggaagaatctgactagagtgagtagtgttttggggagggagaggacctgcataaggggcagaatgattaaaatctgtgcttttctgtgtgttgcagcagcatgagcggaaacggctcctttgagggaggggtattcagcccttatctgacggggcgtctcccctcctgggcgggagtgcgtcaaaatgtgatgggatccacggtggacggccggcccgtacagcccgcgaactcttcaaccctgacctatgcaaccctgagctcctcgtcggtggacgcagctgccgccgcagctgctgcttctgccgccagcgccgtgcgcggaatggccatgggcgccggctattacggcactctggtggccaactcgagttccactaataatcccgccagcctgaacgaggagaagctgctgctgttgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaaaaatcagagtctgaatctttatttgatttttcgcgcacggtaggccctggaccaccggcctcgatcattgagcacccggtggatcttttccaagacccggtagaggtgggattggatattgaggtacatgggcatgagcccgtcccgggggtgaaggtagctccattgcagggcctcgtgctcgggggtggtgttgtaaatcacccagtcatagcagggacgcagggcgtggtgttgcacaatatctttgaggaggagactgatggccacgggcagccctttggtgtaggtgtttacaaacctgttgagctgggagggatgcatgcggggggagatgaggtgcatcttagcctggatcttcagattggcgatgttaccgcccagatcccgcctgggattcatgttgtgcaggaccaccagcacggtgtatccggtgcacttggggaatttgtcatgcaacttggaagggaaggcatgaaagaatttggagacgcccttgtggccgcccaggttttccatgcactcatccatgataatggctatgggcccgtgggcggcggcttgggcaaagacgtttcgggggtcggacacatcgtagttgtggtcctgggtgagatcttcataggccattttaatgaatttggggcggagggtgcccgattgggggacgaaggtaccctcaatcccgggggcgtagtttccctcacagatctgcatctcccaggccttaagctccgagggggggatcatgtccacctgcggggcgataaagaaaacggtttccggggcgggggagatgagctgggcggaaagcaggttgcggagtagctgggacttaccgcagccggtggggccgtagataaccccaatgaccggctgcaggtggtagttgagggagacacagctgccgtcctccctaagaaggggggccacctcgttcatcatttggcgcacgtgcatgttctcgcgcaccagttccgccaggagtcgctctccgcccagcgagaggagctcctggagcgaggcgaagtttttcagcggcttgagcccgtcggccatgggcattttggaaagggtctgttgcaggagttccaagcggtcccagagctcggtgatgtgctctacggcatctcgatccagcagacctcctcgtttcgcgggttggggcgactgcgggagtagggcgccagacgatgggcgtccagcgcggccagggtccggtccttccagggtcgcagcgtccgcgtcagggtggtctccgtcacggtaaaggggtgcgcgccgggctgggcgcttgcgagggtgcgcttcaggctcatccggctggtcgagaaccgctcccgatcggcgccctgtgcgtcggccaggtagcaattgaccatgagttcgtagttgagcgcctcggccgcgtggcctttggcgcggagcttacctttggaagtctgcccacaggcgggacagaggagggacttgagggcgtagagcttgggggcgaggaagacggactcgggggcgtaggcgtccgcgccgcagtgggcgcagacggtctcgcactccacgagccaggtgaggtcgggctgattgggatcaaaaaccagttttccgccgttctttttgatgcgtttcttacctctggtctccatgagctcgtgtccccgctgggtgacaaagaggctgtccgtgtccccgtaaaccgactttatgggtcggtcctcgagtgggacgccgcggtcctcgtcgtagaggaaacccgaccactctgagacgaaggcccgggtccaagccagcacgaaggaggccacgtgggagggatagcggtcgttatccaccagcgggtccaccttctccagtgtatgcaaacacatgtccccctcgtccacatccaggaaggtgattggcttgtaagtgtaggccacgtgaccgggggtcccggccgggggggtataaaagggggcgggccgctgctcgtcttcactgtcttccggatcgctgtccaggagcgccagctgttggggtaggtattccctctcaaaggcgggcatgacctccgcactcaggttgtcagtttctagaaacgaggaggatttgatattgacggtgccggcggagatgcctttcaagagcccctcgtccatctggtcagaaaagacaatctttttgttgtcgagtttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggttagctcgtctggcacgattctgacctgccagccccggttatgcagggtgatgaggtcaacgctggtggccacctcgccgcgcaggggctcgttggtccagcagaggcggccgcccttgcgcgagcagaaggggggcagggggtccagcataagctcgtcgggggggtcagcatcgatggtgaagatgcctggcaggaggtcggggtcgaagtagcttatgcaggtgcccagatcgtccagagaagcttgccattcgcgcacggccagcgcgcgctcgtagggactaaggggcgtgccccagggcatggggtgggtgagcgcggaggcgtacatgccgcagatgtcgtagacgtagaggggctcatcaaggatgccaatgtaggtggggtagcagcggcccccgcggatgctggcgcgcacgtagtcatacaactcgtgcgagggggcgaggagcccggctccgagattggcgcggctgggtttttcggcgcggtagacgatctgacggaagatggcgtgggagttggaggagatggtgggtctttggaagatgttgaagtgggcgtggggcaggccgaccgagtcgcggatgaagtgggcgtaggagtcttgcagcttggcgacaagctcggcggtgacgaggacgtccagggcgcagtagtcaagggtctcttggatgatgtcatacttgagctggcccttttgtttccacagctcgcggttgagaaggaactcttcgcggtccttccagtactcttcaagggggaacccgtcctggtcggcacggtaagagcctagcatgtagaactggttaacggccttgtaggcgcagcagcccttctccacggggagggcataggcctgggcggccttgcgcagggaggtgtgcgtgagggcgaaggtgtccctgaccatgacctttaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttaatgttgtggcccacaatgtatagttccacgaaccgcgggcggcccttgacgtggggcagtttcttgagctcctcgtaggtgagctcgtcggggtcgctgagcccgtgctgctcgagggcccagtcggcgagatgggggttggcgcggaggaaggaagtccagagatccacggccagggcggtttgcagacgatcccggtactggcggaactgctgacccacggccattttttcgggggtgacgcagtagaaggtgcgggggtcgccgtgccaacggtcccattttagctggagggcgagatcaagggcgagctcaacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgaacattcgtgcttgtgtttatacaagcggccacagtgctcgcaacgctgcacgggatgcacgtgctgcacgagctgtacctgggttcctttgacgaggaatttcagtgggaagtggagtcgtggcgcctgcatctggtgctgtactacgtcgtggtggtcggcctggccctcttctgcctcgatggtggtcatgctgacgagcccgcgcgggaggcaggtccagacctcggcgcgaacgggtcggagagcgaggacgagggcgcgcaggccggagctgtccagggtcctgagacgctgcggagtcaggtcagtgggcagcggcggcgcgcggttgacttgcaggagtttttcaagggcgcgcgggaggtccagatggtacttgatctccaccgcgccgttggtggcgacgtcgatggcttgcagtgtcccgtgcccctggggagtgaccaccgtcccccgtttcttcttggcgggcggaagcggtttggcttccatggttaaaagcggcggcgaggacgcgcgccgggcggtaggggcggctcgggacccggaggcagtggtggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagacagttcgacagaatcaatctcggtatcattgacggcggcctgccgcagaatctcttgcacgtcgcccgagttgtcctggtaggcaatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtaaaccacggcgccctcgggatcgcgggcgcgcatgaccacctgggcgaggttgagctccacgtggcgcgcaaaaaccgcgtagttgcagaggcgctggtagaggtagttgagcgtggtggcaatgtgctcagtgacaaagaagtacataatccagcggcggagcggcatttcgctgacgtcgcccagggcttccaagcgctccatggcctcgtaaaagtccacggcgaagttgaaaaactgggagttgcgtgcagatacggtcaagtcctcctccagaagacggatgagctcggcgatggtggcgcgcacctcgcgctcgaaggctcccgggagttcctccacttcctcctcttcatccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggtcgcagcgtaaagacgccgccgcgcatctccaggtggcccggggggtccccgttgggcagggagagtgcgctgacgatgcatcttatcaattgccccgtagggactccgcgcaaggacctaagcgtctctagatccacgggatctgaaaaccgttgaacgaaggcttcgagccagtcgcagtcgcaaggtaggctgagcacggtttcttctggcggcggtggggtgtgggcgggggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatacgcgtgagcccaaacccgcgctgcggctggacgagcgccaggtcagcgacgacgcgctcggcgaggatggcctgctggatctgggtgagggtggtctggaagtcgtcaaagtcgacgaagcggtggtaggctccggtgttaatggtgtaggagcagttggccatgacggaccagttgacagtctggtgaccgggccgcgcgagctcgtggtacttgaggcgcgagtaggcgcgcgagtcgaagatgtagtcgttgcaggtgcgcaccaggtactggtagccgatgaggaagtgcggcggcggctggcggtagagcggccatcgctcggtggcgggggcgccgggcgctaggtcctcgagcatggtgcggtggtagccgtagatgtaccttgacatccaggtgatgccggcggcggtggtggaggcgcgagggaactcgcggacgcggttccagatgttgcgcagcggcaggaagtagttcatggtgggcacggtctggcccgtgaggcgcgcgcagtcgttgatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaggcctgcacaaaacctccaggatacggaggcgggtcgttttgcaaatttttggcggtcgaaaaaagctagtaagcgcggaaagcggccgaccgcaatggctcactgccgtagattggagaagaatcgccagggttgcgttgcggtgtgccccggttcgagaccgctcgggtcggccgaattccgcggctaacgagggcgtggctgccccgtcgtttccaagaccccataagccagccgacttctccagttacggagcgagcccctcttttgttttgttttttgccagatgcatcccgtactgcggcagatgcgcccccaccctccaccgcaacagcagccccctcctacgcaacagccggcgcttctgcctccgccccagcagcagcaacttccagccactaccgccgcggccgccgtgagcggggccgggcagagtcagtatgacctggctttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcagcccgtttccacgcggggcgggagctgcggcgcggcctggacagaaagagggtgctgagggacgaggatttcgaggcggacgagctgacggggatcagccctgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccattgtgcagaaccccaccagcaaaccgctgacggcgcagctgttcctggtggtgcagcacagtcgggacaacgagacttttagggaggcgctgctgaatatcaccgagcccgagggccgctggcttctggacctggtgaatattctgcagagcatcgtggtgcaggagcgcgggctgccgctgtccgagaagctggcggccatcaacttttcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcgccgcgcggtaagcgccagcaggcggcgcgagctgagcgatcaggagctgatgcacagcctgcagcgggccctgaccggggccgggaccgagggggagagctactttgacatgggcgcggacctgcactggcagcccagccgccgggtcttggaagccgcggcggtcccttacgtagaagaggtggacgatgaggatgagggcgagtacctggaagactgatggcgcgaccgtatttttgctagatgcagcaacagccacctcctgatcccgcaatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtgctggccatcgtgaacgcgctggttgagaacaaggccattcgcggcgacgaggccgggctggtgtacaacgcactgctggagcgcgtggcccgctacaacagcaccaacgtgcagaccaacctggaccgcatggtgaccgacgtgcgcgaagccgtggcccagcgcgaacggttccaccgcgagtccaacctgggatccatggtggcactgaacgccttcctcagcacgcagcccgccaacgtgccccggggccaggaggactacaccaacttcattagcgccctgcggctaatggtgaccgaggtgccccagagcgaggtgtaccagtcgggcccggactacttcttccagaccagtcgccagggcttgcagaccgtgaacctgagtcaggctttcaagaacttgcagggactgtggggcgtgcaggctccggtcggggaccgcgcgacggtgtcgagcctgctgacgccgaactcgcgcctgctgctgctgctggtggcgcccttcacggacagcggtagtatcaaccgcaactcgtacctgggctacctgattaacctgtaccgcgaggccattggccaggcgcacgtggacgagcagacctaccaggagattacccacgtgagccgcgccctcggccaggacgacccgggcaatctggaagccaccctgaacttcttgctgaccaaccggtcgcagaagatcccgccccagtacgcgctgagcgccgaggaggagcgtatattgagatacgtgcagcaaagtgtgggactgttcctgatgcaggagggggccacccccagcgccgcgctcgacatgaccgcgcgcaacatggagcccagcatgtacgccagtaatcgcccgtttattaataagctgatggactacctgcatcgggcggccgccatgaactctgactatttcaccaacgccatcctgaacccccactggctcccgccgccggggttctacacgggcgagtacgacatgcccgaccccaatgacgggtttctgtgggacgacgtggacagcagcgtgttctccccccgaccgggtgctaacgagcgccccttgtggaagaaagagggcagcgaccggcgcccgtcctcggcgctgtccggccgcacgggtgctgccgcagcggtgcccgaggccgccagtccctttccgagcttgtcactgaacagcgtccgcagtagcgagctgggcaggatcacgcgcccgcgcttgctgggcgaggaggagtacttaaataactcgctgttgaggcccgagcgggagaagaacttccccaataacgggatagagagtctggtggataagatgagccgctggaagacgtacgcgcatgagcacagggacgatccccgggcaacgcagggggccaccagccggggcagtgccgcccgtaaacgccgctggcacgacaggcagcggggactgatgtgggacgatgaggattccgccgacgacagcagcgtgttggacttgggcgggagtggtggtggtaacccgttcgctcacctgcgcccccgcgtcgggcgcctgatgtaaaaagaaaccaaaaataaatggtactcaccaaggccatggcgaccagcgtgcgttcgtttcttctctgttgtatctagtatgatgaggcgtgcgtacccggagggtcctcctccctcgtacgagagcgtgatgcagcaggcaatggcggcggcggcggcgatgcagcccccgctggaggctccttacgtgccaccgcggtacctggcgcctacggaggggcgaaacagcattcgttactcggagctggcacccttgtacgataccacccggttgtacctggtggacaacaagtcggcggacatcgcctcgctgaactaccagaacgaccacagcaactttctgaccaccgtggtgcagaacaacgatttcacccccacggaggccagcacccagaccatcaactttgacgagcgctcgcggtggggcggtcagctgaaaaccatcatgcataccaacatgcccaacgtgaacgagttcatgtacagcaacaagttcaaggcgcgggtcatggtctcccgcaagacccccaacggggtgacagtaggggatgattatgatggtagtcaggatgagctgaaatacgagtgggtggagtttgagctgcccgaaggcaacttctcggtgaccatgaccattgacctgatgaacaacgccatcatcgacaattacttggcagtggggcggcagaacggggtgctggagagcgacatcggcgtgaagttcgacacccggaacttcaggctgggttgggaccccgtgaccgagctggtcatgcccggggtgtacaccaacgaggccttccaccccgacatcgtgctgttgcccggctgcggggtggactttaccgagagccgcctcagtaatatgctgggcatccgcaagaggcagcccttccaggagggtttccagatcatgtacgaggacctggatggaggtaacatccccgcgctcttggatgtcgaggcctatgagaaaagcaaggaggagagcgtcgccgcgtcaaccgcagccgtagccaccgcctctaccgaggtccggggcgataattttgctagcgccgcagcagtggcggcggccaaggctgatgaaaccgaaagtaagatagttattcagccggtggagaaggatagcaaggataggagctacaacgtgctctcggacaagaaaaacaccgcctaccgcagctggtacctggcctacaactatggcgaccacgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcatgcccgtctactccaagagcttcttcaacgagcaggccgtctactcgcagcagctgcgcgccttcacctcgctcacgcacgtcttcaaccgcttccctgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggtctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgctcgcaactacacccccgccgccgcgcccgtctccaccgtggacgccgtcattgacagcgtggtgtccgacgcgcgccggtacgcccgcgccaagagccggcggcggcgcatcgcccggcggcaccgtagcaccaccgccatgcgtgcggcgcgagccttgctgcgcagggccaggcgcacgggacgcagggccatgctcagggcggccagacgcgcggcttcaggcgccagcgccggcaggactcggagacgcgcggccacggcggcggcagcggccatagccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggagaaggatgtccaagcgcaaattcaaggaagagatgctccaggtcatcgcgcctgagatctacggccccgcggcggcggtgaaggatgaaagaaatccccgcaaaatcaagcgggtcaaaaaggacaaaaaggaagaagatgatgtggacgatatggtagagtttgtgcgcgagtttgccccccggaggcgcgtgcagtggcgcgggcggaaagtgcgtccggtgctgagacccggcaccacggtggttttcgcgcctggcgagcggtccggcacgacatccaagcgctcctacgatgaggtgtacggggacgaggatattctcgagcaggcggccgagcgcctgggcgagtttgcttacggcaagcgcaaccgccttgcgcccctgaaggaagaggtggtgtccatcccgctggaccacggcaaccccacgccgagtcttaagcccgtgaccctgcagcaggtgctgccgagcgcggcgccgcgtcggggcttgaagcgcgagggcgaggatgtgtaccccaccatgcagctgatggtgcccaagcgccagaagctggaagacgtgctggagaccatgaaggtggacccggacgtgcagcccgaggtcaaggtgaggcccatcaagcaggtggccccgggccttggcgtgcagaccgtggacatcaagatccccacggagcccatggaaacgcagaccgaggtcgtgaagcccatcaccagcaccatggaggtgcagacggatccttggatgccggcggcgccccgaaaaccccggcgcaagtacggcgcggccagcctgctgatgcccaactacgcgctgcatccttccatcatccccacgccgggctaccgcggcacgcgcttctaccacggctataccggctcccgccgccgcaagaccaccacccgccgccgtcgtcgccgcacagctgcaactcccgctgccgccctggtgcggagagtgtaccgccgcggccgcgcgcctctgaccctgccgcgggcgcgctaccacccgagcattaccatttaactttgccgtcgcctttgcagatatggctctcacatgccgcattcgcgtccccattacgggctaccgaggaagaaaaccgcgccgtagaaggctggcgggaagcgggatgcgccgccacccccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacacttggaaattgtaataaacccgaatggactctgacgctcctggtcctgtgatgtgtttttgtagacagatggaagacatcaatttttcgtccctggctccgcgacacggcacgcggccgtttatgggcacctggagcgacatcggcaccagccaactgaacgggggcgccttcaattggagcagtctctggagcgggcttaagaattttgggtccacgcttaaaacctatggcagcaaggcgtggaacagcaccacagggcaggcgctgagagataagctgaaagagcagaacttccagcagaaggtagtcgatggcctcgcctcaggcatcaacggggtggtggacctggccaatcaggccgtgcagcggcagatcaacagccgcctggacccggttccccccgccggctccgtggagatgccgcaggtggaggaggagctgcctcccctggacaagcggggcgacaagcgtccccgtcccgacgcggaggagacgctgctgacgcacacggacgaaccgcccccgtacgaggaggcggtgaaactgggcctgcccaccacgcgtcccattgcgcctctagctaccggggtgctgaaacccgagagtagtaagcccgcgaccttggacttgcctcctccgcccactccccgcccctccacagtggctaagcccctgccgccggtggccgtggcccgcgcgcgaccgggggctcgccctcaggcgaactggcagagcactctgaacagcatcgtgggtctgggagtgcagagtgtgaagcgccgccgctgttattaaaaaacactgtagcgcttaacttgcttgtctgtgtatatgtgtatgtccgccgccgctgctgtccagaaggaggagtgaagagaaaggcgcgtcgtcgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcctacccacgatgtgaccaccgaccgcagccagcggctgacgctgcgctttgtgcccgtggaccgggaggacaacacctactcgtacaaagtgcgctacacgctggccgtgggcgacaaccgcgtgctggacatggccagcacctactttgacatccgcggcgtgctggatcggggccctagcttcaaaccctactccggcactgcctacaacagcctggctcccaagggagcgcccaacacctgccagtggaaggattctgacagcaaaatgcatacctttggggcagctgccatgcccggtgttactgggaaaaagatagaagctgatgggctgcctattagaatagattcaacttctggaactgacacagtaatttatgctgataaaactttccaaccagaaccacaagttggaaatgacagttgggttgacaccaatggtgcagaggaaaaatatggaggcagagctctaaaggacactacaaaaatgaaaccctgttatggttcattcgccaagcctaccaacaaagaaggtggtcaggctaacttaaaagattcagaacccgccgccaccactcctaactatgatatagacctggctttctttgacagcaaaactattgttgctaactacgatccagatattgtaatgtacacagaaaatgttgacttgcagactccagatactcatattgtatacaaacctggaacagaggacaccagctctgaatccaatttgggtcagcaggccatgcctaacagacccaactacattggcttcagagacaattttatcgggctcatgtactacaacagcactggcaatatgggggtgctggccggtcaggcctctcagctgaatgctgtggttgacttgcaagacagaaacactgaactgtcctaccagctcttgcttgactctctgggtgacagaacccggtatttcagtatgtggaatcaggcggtggacagctatgatcctgatgtgcgcattattgaaaaccatggtgtggaggatgaattgccaaactattgctttccgttgaatggtgtgggattgacagacacttaccagggtgttaaagttaaaacagatgcaggttctgaaaagtgggacaaagatgacaccacagttagtaatgctaatgaaatccatgtaggcaatccttttgccatggaaatcaacatccaagccaacctgtggaggaacttcctctatgccaatgttgccctctatttgcctgataaatacaaatacacaccggccaacatcaccctgcccaccaacaccaacacctacgagtacatgaacggccgggtggtggcgccctcgctggtggacgcctacattaacattggggcgcgctggtcgctggaccccatggacaacgtaaatcccttcaaccaccaccgcaatgcgggcttgcgctaccgctccatgctcctgggcaacgggcgctacgtgccattccacatccwggtgccccagaaattttttgccattaagagcctcctgctcctgcccgggtcctacacctacgagtggaacttccgcaaggacgtcaacatgatcctgcagagttcccttggcaacgacctgcgcacagacggggcctccatcaccttcaccagcattaacctctacgccaccttcttccccatggcgcacaacaccgcctccacgcttgaggccatgctgcgcaacgacaccaatgaccaatccttcaacgactacctctcggcggccaacatgctctatcccatcccggccaacgccaccaacgtgcccatctccatcccctcgcgcaactgggccgcctttcgcggctggtccttcacgcgactcaagaccaaagagacgccctcgctgggctccgggttcgacccctacttcgtctactcgggctccatcccctacctcgacggcaccttctacctcaaccacaccttcaagaaggtctccatcaccttcgactcttccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggttaactacaaggactaccaggccgtcaccctggcctaccaacacaacaactcgggcttcgttggatacctcgcgcccactatgcgccagggccagccctaccccgccaactacccctacccgctcatcggcaagagcgccgttaccagcgtcacccagaaaaagttcatctgcgacagggtcatgtggcgcatccccttctccagcaacttcatgtccatgggcgcgctcaccgacctcggccagaacatgctctatgctaactccgcccacgcgctagacatgaatttcgaagtcgaccccatggatgagtccacccttctctatgttgtcttcgaagtcttcgacgtcgtccgagtgcaccagccccaccgcggcgtcattgaggccgtctacctgcgcacccccttctcagccggtaacgccaccacataaattcttgcttcttgcaagaagccatggccgcgggctccggcgagcaggagctcagggccatcatccgcgacctggggtgcgggccctacttcctgggcaccttcgataagcgattcccgggattcatggccccgcacaaggtggcctgcgccatcgtcaacacggccggccgcgagaccgggggcgagcattggctggccttcgcctggaacccgcgctcgaacacctgctacctcttcgaccccttcgggttctcggaccagcgcctcaagcaaatctaccagttcgagtacgagggactgctgcgccgcagcgccctggccaccaaggaccgctgcgttaccctggaaaagtccacccagaccgtgcagggtccgcgttcggccgcctgcgggcttttctgctgcatgttcctacacgccttcgtgcactggcccaaccgccccatggacaaaaatcccaccatgaacttgctgacgggggtgcccaacggcatgctccagtcgccccaggtggaacctaccctgcgccgcaaccaggaggcactctaccgcttcctcaactcccactctgcatactttcgctctcaccgcgcgcgcattgagaaggccaccgccttcgaccgcatgaatcaagacatgtaacagtgtgttttaaaatatgtttaataaacagcactttttatgtgacacatgcatttgagataattttattcttaaaaatcgaaggggttctgccgggaggtttcggcatggcccgcgggcagggacacgttgcggaactggtacttggccagccacttgaactcggggatcagcagtttcggcagcagggtgtcggggaacgagtcggtccacagcttccgcgtcagttgcagggcgcccagcaggtcgggcgcggagatcttgaaatcgcagttgggacccgcgttttgcgcgcgagagttgcggtacacagggttgcagcactggaacaccatcagggccggatgcttcacgctcgccagcaccgtagcgtcggtgatcccgtccacgtcgaggtcttcggcgttggccatcccgaagggggtcatcttgcaggtctgccggcccatggtgggcacgcagccgggcttgtggttgcaatcgcagtgcagggggatcagcatcatctgggcctggtcggcgttcatccccgggtacatggccttcatgaaagcctccagctgcttaaacgcctgctgggccttggctccctcggtgaagaagaccccgcaggacttgctagaaaactggttggtagcgcacccggcgtcgtgcacgcagcagcgcgcgtcgttgttggccagctgcaccacgctgcgcccccagcggttctgggtaatcttggcccggtcggggttctcctttagcgcgcgttgcccgttctcgcttgccacatccatctcgatcatgtgctccttctggatcatggtggtcccgtgcaggcaccgcagcttgccctcgacttcggtacagccgtgcagccacagcgcgcaccccgtgctctcccagttcttgtgggcgatctgggaatgcgcatgcacgaacccctgcaggaagcggcccatcatggtcgtcagggtcttgttactggtaaaggtcagcggaatgccgcggtgctcctcgttgatgtacaggtggcagatgcggcgatacacctcgccctgctcgggcatcagttggaagttggattttaggtcgctttccacacggtagcgctccatcagcatattcatgatttccatgcccttctcccaggccgatacaatgggcaggctcagggggttcgtcaccgccatcttagcgctagcagccttcgtcagcgggtcgttctcattgagagtctcaaagctccgcttgccgtccttctcggtgatccgcacgggggggtagctgaagcccacggccgccagctcctcctcggcctctctttcgtcctcgctgtcctggctgacgtcctgcaggggcacatgcttcgttttgcggggtttctttttgggcggctgctgcggcggcggtggttgttcctgaggcgagggggagcgcgagttctcgctcaccactactatctcttcttcttggtccgaggccacgcggcggtaggtatgtctcttcaggggcagaggcggaggcgacgggctctcgcggcccggcgggtggctggcagagccccttccgcgatcgggggtgcgctcccggcggcgctctaactgacttcctccgcggccggccattgtgttctcctagggaacaacaacaagcatggagactcagccatcgtcgccaacctcgccatctgcccccaccgccgacaagaagcagcagcagaatgagagcttaaccgccccgccgcccagccccgccacctttgtcgcggccccagacatgcaagagatggaggaatccattcagattgacctgggctatgtgacgcccgcggagcacgaggaggagcttgcagtgcgcttttcaacccaggaagagatacaccaagaacagccagagcaggaagcaaagagcgagcatgactacctccaccagagcgggggggaggacgccctcatcaagcatctggcccggcaggccatcatcgtcaaggacgcgctgcttgaccgcaccgaggtgcccctcagcgtggaggagctcagccgcgcctacgagctcaacctcttctcgccgcgcgtgccccccaagcgccagcccaacggcacctgcgagcccaacccacgcctcaacttctacccggtcttcgcggtgcccgaggccctggccacctaccacatctttttcaagaaccaaaggatccctgtctcctgtcgcgccaaccgcacccgcgccgactcccttttcaacctgggccccggtgcccgcctacctgatatcgcctccttggaagaggttcccaagatcttcgagggtctgggcagcgacgagactcgggccgcaaacgctctgcaaggagaaggaggagatcatgagcaccacagcgccctggtggagttggaaggcgacaacgcgcgtctggcggtgctcaagcgcacgatcgagctgacccatttcgcctacccggcgcttaacctgccccccaaagtcatgagcacggttatggaccaggtgctcatcaagcgcgcgtcgcccatctccaaggagatgcaagaccccgagagctccgaggagggcaagcccgtggtcagcgacgagcagctggcgcggtggctgggaccccaagctagtccccagagcttggaagagcggcgcaagctcataatggccgtggtcctggtgaccgcggagctggagtgtctgcgccgcttcttcgccgacgcagaaactctgcgcaaggtcgaggagaacctgcactacatcttcaggcacgggttcgtacgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtttacctctacctctgccacacctggcagacagccatgggcgtgtggcagcagtgtctggaggagcagaacctaaaagagctctgcaagctcctgcagaagaacctcaaggccctgtggaccgggttcgacgagcgcaccaccgcctcggacctggcagacctcattttccccgagcgtctcaggctgacgctgcgcaacggtttgcccgactttatgagtcaaagcatgttgcaaaactttcgctctttcatcctcgaacgctccgggatcctgccggccacctgctccgcgctgccctcggacttcgtgccgctgaccttccgcgagtgccccccgccgctgtggagccactgctacctgctgcgcttggccaactacctggcctaccactcggacgtgatcgaggacgtcagcagcgagggcctgctcgagtgccactgccgctgcaacctctgcacgccgcaccgctccctggcctgcaacccccagctgctgagcgagacccagatcatcggcaccttcgagttgcaagggcccggcgatgagggttctgccgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagctatccagaaatcccgccaagaattcttgctgaaaaagggccgcggggtctaccttgatccccagaccggtgaggagcttaaccccggcttcccccaggatgccccgaggaagcagcaagaagctgaaagtggagctgccgcccgtggaggatttggaggaagactgggagagcagtcaggcagaggaggaggagatggaagactgggacagcactcaggcagaggacagcctgcaagacagtctggaagacgaggaggaggcagaggaggtggaagaagtagccgccgccgccagaccgtcgtcctcggcggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaagcttgcgggggcaacatctcattcacccggcgctacctgctctttcaccgcggggtgaacttcccccgcaacatcttgcattactaccgtcacctccacagcccctactacttccaagaagaggcagaaaaagacaaaaccagcagctagaaaatccacagcggcggcggcaggtggactgaggatcgcggcgaacgagccggcgcagacccgggaactgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcacgcttgaggacgccgaggctctcttcaacaagtactgcgcactcactcttaaagagtagcccgcgcccgcccacacacggaaaaaggcgggaattacgtcacctgtgcacccccacccagcaccgctatgagcaaagaaattcccacgccttacatgtggagctaccagccccagatgggcctggccgccggcgccgcccaggactactccacccgcatgaattggctcagcgccgggcccgggatgatctcacgggtgaatgacatccgcgcccaccgaaaccagatactcctagaacagtcagcgctcaccgccacgccccgcaatcacctcaatccgcgtaattggcccgccgccctagtgtaccaggaaattccccagcccacgaccgtactacttccgcgagacgcccaggccgaagtccagctgactaactcaggtgtccagctggcgggcggcgccaccctgtgtcgtcaccaccccgctcagggtataaagcggctggtgatccggggcagaggcacacagctcaacgacgaggtggtgagctcttcactgggtttgcgacctgacggagtcttccaactcgccggatcgggaagatcttccttcacgcctcgtcaggccgtgctgactttggagagttcttcctcgcaacctcgctcgggcggcatcggcactctccagtttgtggaggagttcactccctcggtctacttcaaccccttctccggctcccccggccactatccggacgagttcatcccgaacttcgatgccatcagcgaatcggtagacggctacgattgaatgtcccatggtggcgcggctgacctagctcggcttcgacacctggaccactgccgccgctttcgctgcttcgctcgggacctcgccgagtttacctactttgagctgtccgaggagcaccctcagggcccggcccacggagtgcggatcgtcgtcgaagggggcctagactcccacctgcttcgtatcttcagccagcgcccgatcctggtccagcgccaacagggcaacaccctcctgaccctttactgcatctgcaaccaccccggcctgcatgaaagtctttgttgtctgctgtgtactgagtataataaaagctgagatcagcgactactccggactcgattgtgttcctgcatccctcaaccagtctctgaccttcaccgggaacgaaacagagctccatctccagtgtaagccccacaaaaagtacctcacctggctgcaccagggctccccaatcgccgttgttaaccactgcaacgacgacggagtcctgctgaacggccccgccaaccttactttttccacccgcagaagcaagctactgctcttccgacccttcctaccagggatctatcagtgcgtctcgggaccctgccatcacaccttccacctgatcccgaataccacctcttccccagcgccgctcctcactaacaaccaaactaaccaccaccaacgctaccgtcgagacctcgttgaatctaataccacccacaccggaggtgagctccgaggtcctcagtcatctgggatttattacggtccctgggaggtggtggggttaatagctttaggcttagtagcgggtgggcttttggctctttgctacctatacctcccttgcttttcctacttagtggtgctttgttgctggtttaagaaatggggaagatcaccctagtgtgcggtgtgctggtggcggtactttcgattttgggtctgggcagcgcggctgtagtgacggagaaggccgatccctgcttgacttttaaccccgacaaatgccagctgagttttcagccagatggcaatcggtgcgcggtgttgattaagtgcggatgggaatgccagagcgtggcgatccagtataaaaacaagacgcggaacaatactctcgcgtccacatggcagcccggggaccccgagtggtacaccgtctctgtccctggtgctgacggcttccttcgcacggtaaacaacacttttatttttgagcacatgtgcaataccgccatgttcatgagcaggcagtaccatatgtggcccccacggaaagagaatatcgtggtcttctccatcgcttacagcttgtgcacggtgctaatcaccgcgatcgtgtgcctgagcattcacatgctcatcgctattcgccccagaaataatgctgagaaagagaaacagccataacaccattttttcacacacctttttcagaccatggcctctgttacagccattatttattttttgggtcttctgggatttatcaacagttttgaccataaaaacgtaactgcttatgttggttctaactgtgtactaactgggtaccagtcacaccaacgggtttcatggtactggtttgataaaaaaaacacagcttatacactttgcaaaggtaatcagcggcccacacagcgcagtggtctttattacagctgcactaataataatatcacactacttcaagtgactaaacaatattctgggacatactatggaaccaattttaacacggaacaggacacttactatagtgtcaaagtattggatccaactactcccagaactactaccaaacataccacaactaaaaagcccactatacctaaaaccactaaattaacaaccacaaccagcaccacacttgctgtgacctcacaggcaactactgaaaacgaattggttgccctgttgcagaatggggagaataatagcagcagtcctctgcctaccacccccagtgagcaaattcccagatccatgattggcattatcgctgctgtggtggtgtgtatggtcattatcatcttgtgcatgatgtactatgcctgctactacagaaaacacagactgaacaacaagctggacccctactgaattttgatttttaattacaaattaattgtggttgatcccactacacctccacccaccacaactaccacagacacacaagaacccactccagaggcagtagcagagttagcaaagcagatttatgaagattcctttgttgctaatactcccacacacctcggaccgcaatgtccagggttagtagtcagcggcatcgtcggtgtgctttgtgggttagcagttataatcatctgcatgttcatttttgcttgctgctacagaaggcttcaccgacagaaatcagacccactgctgaacctctatgtttaatttttgattttccagagccatgaaggcacttagcactttagtttttttgtccttgattggcattgtttttagtaatcctattcctagagttagctttattaaaccagttaatgttactgaagggagcaatgtgacactggtaggtgtagagggtgctaaaaacaccacctggacaaaatatcaccttaatgggtggaaagatatctgcaattggagtgtgacagtttatacatgcgagggagttaatcttaccattgtcaatgcaacctcagctcaaaatggtagaattcaagggcaaagtgttagtgattctgaggggtattatacccaacatacttttatctatgacattaaggtcataccattgccaacacccagcccacctagcactactcaaaccactacatcaactcagcccaccgccaccacaacagcagaggcatttttgttgctgccaccatctagcagtcccactgctagtaccaataagcagactactaaatttttgtccactactgaaagccacaccacagctaccttgagagccttctctagcaccgctaatcttacctcgctttcctatacattaatcagttctgttactacctctaccccagcttctcttcccactcccctgaagcaaaccgaaggcggtttgcaatggcagatcaccctactcattgtgatcggggtggtcatcctagcgatgctgctctacttcatcttctgccgccgcatccccaacgcgaaaccggtctacaagcccatcgttatcgggcagccggagccgcttcaggtggagggaggtctaaggaatcttctcttctcttttacagtatggtgatttgaactatgattcctagacagttctttatcattggtcttctctgcgcgctccaagtctgtgccaccctcgctctggtggctaatgcgagtccagactgcattggaccgttcgcctcctacgtgctctttgccttcatcacctgcatctgctgctgtagcatagtctgcctgcttattaccttcttccagttcgttgactgggtctttgtgcgcatcgcctacctgcgccaccacccccagtaccgcgaccaaagagtggcgcagctgctcaggctcatctgataagcatgcgggctttgctacttctcatgcttctactattgctagctcccctggtcgccccctttcccctcaaatcccccacccagtcccccaaagaggttcgaaactgtaaattccaagaaccctggaaattcctcaaatgctaccagctcaaatcagacatgcaccccagctggataattatcatgggaatcgtgaacatccttgcctgcaccttcttttcctttgtgatttacccccgctttgactttggttggaacgcacccgaggcgctctggctcccgcctgatcccgacacaccaccacagcagcagcaaaatcaggcacacgcaccaccaccacagcctaggccccaatacatgcccatcttaaactatgaggccgagccacaacgagccatgcttcctgctattagttacttcaatctaaccggtggagatgactgacccactcaacaacactgtcaacgacctcctggacatggacggccgcggctcggagcagcgtctcgcccaactccgcattcgccagcagcaggagagagccgtcaaggagctgcaggacgcagtggccatccaccagtgcaagaaaggcatcttctgcctggtgaagcaggccaagatctccttcgaggtcacttccaccgaccatcgcctctcctacgagctcctgcagcagcgccagaagttcacctgcctggtcggagtcaaccccatcgtcatcacccagcagtctggcgataccaagggttgcatccactgctcctgcgactcccccgagtgcgttcacaccctgatcaagaccctatgcggcctccgcgacctcctccccatgaactaatcaactaaccccttaccccattacccatccagtaaaaaaaataaagattaaagagacgatgattttgaattgatcaataaagaatcacttacttgaaatctgaaaccaggtctctgtccatgttttctgtcagcagcacttcgctcccctcttcccagctctggtactgcaggccccggcgggctgcaaacttcctccacactctgaaggggatgtcaaattcctcctgtccctcaatcttcattttttatttctattagatgtccaaaaagcgcgcgcgggtggatgatggcttcgaccccgtgtatccctacgatgcagacaacgcaccgaccgtgcccttcatcaaccctcccttcgtctcttcagatggattccaagaaaagcccctgggggtgttgtcccttaggctggccgaccctgtcaccaccaagaatggggaaattaccctcaagctgggggagggggtggaccttgacgactcgggaaaactcattgcaaacacagtaaacaaggccattgcccctctcagtttttccaacaacaccatttcccttaacatggatacccctttatacaccaaagatggaaaactatccttacaagtttctccaccattaagtatattaaaatcaacaattttgaatacattagctctagcttttggctcaggtttaggactcagtggcagcgccctggcagtacagttagcctctccacttacatttgatgataaagggaatataaagattaccctaaacaggggattgcatgttacaacaggagatgcaattgaaagcaacatcagttgggctaaaggtataaaatttgaagatggtgccatagctacaaacattggtaaggggctagagttcggaaccagtagtacagaaacaggagttaataatgcttatccaatccaagttaaacttggctctggtctcagctttgacagcacaggagccataatggctggcaataaagactatgataaattaactttgtggacaacgcctgacccatcaccaaactgtcaaatacttgcagaaaatgatgcaaaactaacactttgcttaactaagtgtgacagtcaaatactggccactgtatcagttttggttgttagaagtggaaacttaaacccaattactggcacagtaagcagtgctcaagtttttctacgttttgatgcaaatggtgttcttttaacagaacactctacactaaaaaaatactggggctacaagcaaggagatagcatagatggcactccatacaccaatgctgttggttttatgccaaattcaacagcttatccaaagacccaaagttctactactaaaaataatatagtgggtcaagtatacatgaatggagatgtttcaaaacccatgcttcttactataactcttaatggtactgatgacaccaccagtgcatactcaatgtcattttcatacacctggactaacggaagctatatcggagcaacatttggagctaactcatacaccttctcctacatagcccaacaataatcccaccctgcatgccaacccaccttttccctctatttataaatggaaactgaaacaaaaataaagttcaagtgttttattgattcaacagtttttcacaggattcgagtagttattttccctccaccctcccatctcatggaatacactatcctctccccacgcacagccttaaacatctgaatgctattggtaatggacatggttttgatctccacattccacacagtttcagagcgagacagtctcgggtcggtcaaggagatgaaaccctccgggcactcctgcatctgcacctcacagttcaacagctgagggctgtcctcggtgattggaatcacagttatctggaataagagcgatgagaatcataatccgcaaacgggatcgggcggttgtggcgcatcaggccccgcagcagtcgctgtctgcgccgctccgtcaagctgctactcaaggggtccgggtccagggactccctgcgcatgatgccaatggccctgagcatcagtcgcctggtacggcgggcgcagcagcggatgcggatctcactcaggtcggagcagtacgtgcagcacagcaccaccaagttgttcaacagtccatagttcaacgtgctccagccaaaactcatttgtggaactatgctgcccacatgtccatcgtaccagatcctgatgtaaatcaggtggcgtcccctccagaacacactgcccatgtacatgatctccttgggcatgtgcaggttcaccacctcccggtaccacatcacccgctggttgaacatgcagccctggataattctgcggaaccagatggcaagtaccgtcccgcccgccatgcagcgcagggaccccgggttctggcaatggcagtggatcacccaccgctcgcgaccgtggatcaactgggaactaaacaagtctatgttggcacagcacaggcacacgctcatgcatgtcttcagcactctcaattcctcgggggtcaggaccatatcccagggcacagggaactcttgcaggacagtgaacccggccgaacagggcaatcctcgcacggaacttacattgtgcatggacagggtatcgcaatcaggcagcaccggatgatcctccaccagagaagcgcggctctcggtctcctcacagcgaggtaaggtggccggcggttggtacggatgatggcgagataacgctaatcgtgttctggatcgtgtcatgatggagctgtttccggacattttcgtatttcacaaagcagaacctggtccgggcactgcacaccgctcgtcggcgacggtctcggcgcttcgagcgctcaatgttgaagttatagaacagccactccctcagaacgtgcagtatctcctgagcctcttgggtgatgaaaatcccatccgccctgatggctctgattacatcaaccacggtggaatgggccaaacccagccagatgatgcaattttgttgggtttcggtgacggcgggggagggaagaacaggaagaaccatgattaactttattccaaacggtctcggaacacttcaaaatgcaggtcccggaggtggcacctctcgcccccactgtgttggtggaaaataacagccaggtcaaaggtaacacggttctcgagatgttccacggtggcttccagcaaagcctccacgcgcacatccagaaacaagaggacagcgaaagcgggagcgttttctaattcctcaatcatcatattacactcctgcaccatgcctagataattttcatttttccagccttgaatgattcgtattagttcctgaggtaaatccaagccagccatgataaaaagctcgcgcagagcgccctccaccggcattcttaagcacaccctcataattccaacagattctgctcctggttcacctgtagtagattaacaagtggaatatcaattgctctgccgcaatccctaagctcctcccttagcagtaactgtatgtactcattcatatcttctccgaaatttttagccataggaccaccaggaacaagagaagggcaagccacattacagataaagcgaagtcctccccagtgagcattgccaaatgtaagattgaaataagcatgctggctagacccggtgatatcttccagataactggacagaaaatcaggcaagcaatttttaagaaaattaacaaaagaaaagtcgtctaggtgcacgtttagagcctcaggaacaacgatggaataagtgcaaggagtacgttccagcatggttagtgtttttggtgatctgtagaacaaaaaataaacatgcaatattaaaccatgctagcctggcgaacaggtggataaatcactctttccaacaccaggcaggctacagggtctccggcgcgaccattgtagaagctgacattatgattaaaaagcatcaccgacagaccttcccggtggccggcatggatgattcgagaagaagcatacactccgggaacattggcgtccgtgagtgaaaaaaagcgacctataaagccttgaggcactacaatgcttaatcttaattccagcaaagcgaccccatgcggatgaagcacaaaattggcaggtgcgtaaaaaatgtaattactccccttctgcacaggcagcaaagcccccgctccctccagaaacacatacaaaacctgagcgtccatagcttaccgagcacggcaggcgcaagagtcagagaaaaagctgagctctaacctaactgcccgcttctgtactcaatatatagccctaacctcactgacgtaaaggccaaggtctaaaaatacccgccaacacgcccagaaaccggtgacacactaaaaaaatacgtgcacttcctcaaacgcccaaactggcgtcatttccggtttcccacgctacgtcacctctcaacgactttcaaattccgtcgaccgttaaacacatcagttaccccgcccctaacgaacgccgctgtcacagccaatcagcgcgccccatccccaaattttcacgccttatttgcatattaactcacacaaaaaaaataaggtatattatatagatag

SEQ ID NO: 578 - DNA, 35994 bp, Ad4 vaccine from Calif. Public Health
catcatcaataatataccttattttttttgtgtgagttaatatgcaaataaggcgtgaaaatttggggatggggcgcgctgattggctgtgacagcggcgttcgttaggggcggggcaggtgacgttttgatgacgcgactatgaggaggagttagtttgcaagttctggtggggaaaagtgacgtcaaacgaggtgtggtttaaacacggaaatactcaattttcccacgctgtctaacaggaaatgaggtgtttttgggcggatgcaagtgaaaacggaccattttcgcgcgaaaactgaatgaggaagtgaaatctgagtaatttagtgtttatgacagggaggagtatttgccgagggccgagtagactttgaccgtttacgtgggggtttcgattaccgtgtttttcacctaaagttccgcgtacggtgtcaaagtccggtgtttttacgtaggtgtcagctgatcgtcagggtatttaaacctgcgctctgcagtcaagaggccactcttgagtgccagcgagaagagttttctcctccgcgccgcgagtcagatctacactttgaaatatgaggcacctaagagacctgcccgatgaggaaattatcatcgcttccgggagcgagattctggaactggtggtaaatgctatgatgggcgacgaccatccggaaccccccaccccatttgagacaccttcgctgcacgatttgtatgatctggaggtggatgtgcccgaggacgaccccaacgagaaggcggtaaatgatttatttagcgatgccgcgctgctagctgccgaggaggcttcaagccctagctcagacagcgactcttcactgcatacccctagacacgacagaggtgagaaagagatccccgggcttaaatgggaaaagatggacttgcgttgctatgaggaatgcctgcccccaagcgatgatgaggacgagcaggcgattcagaacgcagcgagccatggagtgcaagccgtcagcgagagctttgcactggactgcccgcctttgcccggacacggctgtaagtcttgtgaatttcatcgcatcaatactggagataaagctgtgttatgtgcactttgctatatgagagcgtacaaccattgtgtttacagtaagtgtgattaagtgaactttaaagggaggcaaagagtagggtgactgggtgatgactggtttatttatgtatatctgttttttatataggtcccgtttctgacgcagatgatgagacccccactacagagtccactttgtcaccccctgaaattggcacgtctccatctgacaatattgttagaccagttcctgtaagagccactgggaggagagcagctgtagaatgtttggatgatttgcttcagggtggagatgaacctttggacttgtgtacccggaaacgccccaggcattaagtgccacacatgtgtgtttacttgaggtgatgtcagtatttatagggtgtggagtgcaataaaatatgtgttgactttaagtgcgtggtttatgactcaggggaggggactttgggtatataagcaggtgcagacctgtgtggttagctcagagcggtatggagatttggacggttttggaagactttcacaagactaggcagctgctagagaacgcctcgaacggagtctcttacctgtggagattctgcttcggcggtgacctagctaagctagtctatagggccaaacaggattatagggaacaatttgaggatattttgagagagtgtcctggtctttttgacgctcttaacttgggccatcagtctcactttaaccagagaatttcaagagcccttgactttactactcctggcagaaccactgcagcagtagccttttttgcttttatttttgacaaatggagtcaagaaacccatttcagcagggattaccagctggatttcttagcagtagctttgtggagaacatggaagtgccagcgcctgaatgcaatctccggctacttgccggtacagccgctagacactctgaggatcctgagtctccagcagcaggaggatcaagaagagaatccgagagccggcctggaccctccggcggaggagtagctgacctgtttcctgaactgcaccgggtgctgactaggtcttcgagtggtcgggagaggggtattaagcgggagaggcatgatgagactaatcacagaattgaactgactgtgggtctgatgagccgcaagcgtccagaaacagtgtggtggtatgaggtgcagtcaactggcacagatgaggtgtcagtcatgcatgagagattttccctagaacaagtcaagacttgttggttggagcctgaggatgattgggaggtagccatcaggaattatgccaagctggctctgaggccagatagaaagtacaagattactaagctgataaatatcagaaatgcctgctacatctcagggaatggggctgaagtggagatctgtctccaggatagagtggctttcagatgctgcatgatgaatatgtacccgggagtggtggacatggatggggtcacctttatgaacatgaggttcaggggagatgggtataatgggacggtctttatggccaataccaagctgacagtgcatggatgctccttctttgggtttaataacacctgcatcgaggcttggggtcaggtcggtgttaaggggtgcagtttttcagccaactggatgggggtagtgggcaggaccaagagtatgctgtctgtgaagaaatgcttgtttgagaggtgccacctgggggtgatgagcgagggcgaagccagaatccgccactgtgcctctaccgagacgggctgttttgtgctgtgcaagggcaatgccaagatcaagcataatatgatctgtggagcctcggacgagcgcggctaccagatgctgacctgcgccggtgggaacagtcatatgctggccgccgtgcatgtggcttcccattcccgcaagccctggcctgagttcgagcacaatgtcatgaccaggtgcaatatgcatctgggggctcgccgaggcatgtttatgccctaccagtgcaacctgaattatgtaaaggtgctcctggagcccgatgtcatgtccagagtgagcctgacgggggtgtttgacatgaatgtggaagtgtggaagattctaagatatgatgaatacaagaccaggtgtcgagcctgcgagtgcggagggaagcatgccaggttccagcccgtgtgtgtggatgtgacggaggacctgcgacccgatcatttggtgttgtcctgcaccgggacggagttcggctccagtggggaagaatctgactagagtgagtagtgttttggggagggagaggacctgcataaggggcagaatgattaaaatctgtgcttttctgtgtgttgcagcagcatgagcggaaacggctcctttgagggaggggtattcagcccttatctgacggggcgtctcccctcctgggcgggagtgcgtcaaaatgtgatgggatccacggtggacggccggcccgtacagcccgcgaactcttcaaccctgacctatgcaaccctgagctcctcgtcggtggacgcagctgccgccgcagctgctgcttctgccgccagcgccgtgcgcggaatggccatgggcgccggctattacggcactctggtggccaactcgagttccactaataatcccgccagcctgaacgaggagaagctgctgctgttgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaaaaatcagagtctgaatctttatttgatttttcgcgcacggtaggccctggaccaccggcctcgatcattgagcacccggtggatcttttccaagacccggtagaggtgggattggatattgaggtacatgggcatgagcccgtcccgggggtgaaggtagctccattgcagggcctcgtgctcgggggtggtgttgtaaatcacccagtcatagcagggacgcagggcgtggtgttgcacaatatctttgaggaggagactgatggccacgggcagccctttggtgtaggtgtttacaaacctgttgagctgggagggatgcatgcggggggagatgaggtgcatcttagcctggatcttcagattggcgatgttaccgcccagatcccgcctgggattcatgttgtgcaggaccaccagcacggtgtatccggtgcacttggggaatttgtcatgcaacttggaagggaaggcatgaaagaatttggagacgcccttgtggccgcccaggttttccatgcactcatccatgataatggctatgggcccgtgggcggcggcttgggcaaagacgtttcgggggtcggacacatcgtagttgtggtcctgggtgagatcttcataggccattttaatgaatttggggcggagggtgcccgattgggggacgaaggtaccctcaatcccgggggcgtagtttccctcacagatctgcatctcccaggccttaagctccgagggggggatcatgtccacctgcggggcgataaagaaaacggtttccggggcgggggagatgagctgggcggaaagcaggttgcggagtagctgggacttaccgcagccggtggggccgtagataaccccaatgaccggctgcaggtggtagttgagggagacacagctgccgtcctccctaagaaggggggccacctcgttcatcatttggcgcacgtgcatgttctcgcgcaccagttccgccaggagtcgctctccgcccagcgagaggagctcctggagcgaggcgaagtttttcagcggcttgagcccgtcggccatgggcattttggaaagggtctgttgcaggagttccaagcggtcccagagctcggtgatgtgctctacggcatctcgatccagcagacctcctcgtttcgcgggttggggcgactgcgggagtagggcgccagacgatgggcgtccagcgcggccagggtccggtccttccagggtcgcagcgtccgcgtcagggtggtctccgtcacggtaaaggggtgcgcgccgggctgggcgcttgcgagggtgcgcttcaggctcatccggctggtcgagaaccgctcccgatcggcgccctgtgcgtcggccaggtagcaattgaccatgagttcgtagttgagcgcctcggccgcgtggcctttggcgcggagcttacctttggaagtctgcccacaggcgggacagaggagggacttgagggcgtagagcttgggggcgaggaagacggactcgggggcgtaggcgtccgcgccgcagtgggcgcagacggtctcgcactccacgagccaggtgaggtcgggctgattgggatcaaaaaccagttttccgccgttctttttgatgcgtttcttacctctggtctccatgagctcgtgtccccgctgggtgacaaagaggctgtccgtgtccccgtaaaccgactttatgggtcggtcctcgagtgggacgccgcggtcctcgtcgtagaggaaacccgaccactctgagacgaaggcccgggtccaagccagcacgaaggaggccacgtgggagggatagcggtcgttatccaccagcgggtccaccttctccagtgtatgcaaacacatgtccccctcgtccacatccaggaaggtgattggcttgtaagtgtaggccacgtgaccgggggtcccggccgggggggtataaaagggggcgggccgctgctcgtcttcactgtcttccggatcgctgtccaggagcgccagctgttggggtaggtattccctctcaaaggcgggcatgacctccgcactcaggttgtcagtttctagaaacgaggaggatttgatattgacggtgccggcggagatgcctttcaagagcccctcgtccatctggtcagaaaagacaatctttttgttgtcgagtttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggttagctcgtctggcacgattctgacctgccagccccggttatgcagggtgatgaggtcaacgctggtggccacctcgccgcgcaggggctcgttggtccagcagaggcggccgcccttgcgcgagcagaaggggggcagggggtccagcataagctcgtcgggggggtcagcatcgatggtgaagatgcctggcaggaggtcggggtcgaagtagcttatgcaggtgcccagatcgtccagagaagcttgccattcgcgcacggccagcgcgcgctcgtagggactaaggggcgtgccccagggcatggggtgggtgagcgcggaggcgtacatgccgcagatgtcgtagacgtagaggggctcatcaaggatgccaatgtaggtggggtagcagcggcccccgcggatgctggcgcgcacgtagtcatacaactcgtgcgagggggcgaggagcccggctccgagattggcgcggctgggtttttcggcgcggtagacgatctgacggaagatggcgtgggagttggaggagatggtgggtctttggaagatgttgaagtgggcgtggggcaggccgaccgagtcgcggatgaagtgggcgtaggagtcttgcagcttggcgacaagctcggcggtgacgaggacgtccagggcgcagtagtcaagggtctcttggatgatgtcatacttgagctggcccttttgtttccacagctcgcggttgagaaggaactcttcgcggtccttccagtactcttcaagggggaacccgtcctggtcggcacggtaagagcctagcatgtagaactggttaacggccttgtaggcgcagcagcccttctccacggggagggcataggcctgggcggccttgcgcagggaggtgtgcgtgagggcgaaggtgtccctgaccatgacctttaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttaatgttgtggcccacaatgtatagttccacgaaccgcgggcggcccttgacgtggggcagtttcttgagctcctcgtaggtgagctcgtcggggtcgctgagcccgtgctgctcgagggcccagtcggcgagatgggggttggcgcggaggaaggaagtccagagatccacggccagggcggtttgcagacgatcccggtactggcggaactgctgacccacggccattttttcgggggtgacgcagtagaaggtgcgggggtcgccgtgccaacggtcccattttagctggagggcgagatcaagggcgagctcaacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgaacattcgtgcttgtgtttatacaagcggccacagtgctcgcaacgctgcacgggatgcacgtgctgcacgagctgtacctgggttcctttgacgaggaatttcagtgggaagtggagtcgtggcgcctgcatctggtgctgtactacgtcgtggtggtcggcctggccctcttctgcctcgatggtggtcatgctgacgagcccgcgcgggaggcaggtccagacctcggcgcgaacgggtcggagagcgaggacgagggcgcgcaggccggagctgtccagggtcctgagacgctgcggagtcaggtcagtgggcagcggcggcgcgcggttgacttgcaggagtttttcaagggcgcgcgggaggtccagatggtacttgatctccaccgcgccgttggtggcgacgtcgatggcttgcagtgtcccgtgcccctggggagtgaccaccgtcccccgtttcttcttggcgggcggaagcggtttggcttccatggttaaaagcggcggcgaggacgcgcgccgggcggtaggggcggctcgggacccggaggcagtggtggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagacagttcgacagaatcaatctcggtatcattgacggcggcctgccgcagaatctcttgcacgtcgcccgagttgtcctggtaggcaatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtaaaccacggcgccctcgggatcgcgggcgcgcatgaccacctgggcgaggttgagctccacgtggcgcgcaaaaaccgcgtagttgcagaggcgctggtagaggtagttgagcgtggtggcaatgtgctcagtgacaaagaagtacataatccagcggcggagcggcatttcgctgacgtcgcccagggcttccaagcgctccatggcctcgtaaaagtccacggcgaagttgaaaaactgggagttgcgtgcagatacggtcaagtcctcctccagaagacggatgagctcggcgatggtggcgcgcacctcgcgctcgaaggctcccgtgagttcctccacttcctcctcttcatccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggtcgcagcgtaaagacgccgccgcgcatctccaggtggcccggggggtccccgttgggcagggagagtgcgctgacgatgcatcttatcaattgccccgtagggactccgcgcaaggacctaagcgtctctagatccacgggatctgaaaaccgttgaacgaaggcttcgagccagtcgcagtcgcaaggtaggctgagcacggtttcttctggcggcggtggggtgtgggcgggggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatacgcgtgagcccaaacccgcgctgcggctggacgagcgccaggtcagcgacgacgcgctcggcgaggatggcctgctggatctgggtgagggtggtctggaagtcgtcaaagtcgacgaagcggtggtaggctccggtgttaatggtgtaggagcagttggccatgacggaccagttgacagtctggtgaccgggccgcgcgagctcgtggtacttgaggcgcgagtaggcgcgcgagtcgaagatgtagtcgttgcaggtgcgcaccaggtactggtagccgatgaggaagtgcggcggcggctggcggtagagcggccatcgctcggtggcgggggcgccgggcgctaggtcctcgagcatggtgcggtggtagccgtagatgtaccttgacatccaggtgatgccggcggcggtggtggaggcgcgagggaactcgcggacgcggttccagatgttgcgcagcggcaggaagtagttcatggtgggcacggtctggcccgtgaggcgcgcgcagtcgttgatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaggcctgcacaaaacctccaggatacggaggcgggtcgttttgcaaatttttggcggtcgaaaaaagctagtaagcgcggaaagcggccgaccgcaatggctcactgccgtagattggagaagaatcgccagggttgcgttgcggtgtgccccggttcgagaccgctcgggtcggccgaattccgcggctaacgagggcgtggctgccccgtcgtttccaagaccccataagccagccgacttctccagttacggagcgagcccctcttttgttttgttttttgccagatgcatcccgtactgcggcagatgcgcccccaccctccaccgcaacagcagccccctcctacgcaacagccggcgcttctgcctccgccccagcagcagcaacttccagccactaccgccgcggccgccgtgagcggggccgggcagagtcagtatgacctggctttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcagcccgtttccacgcggggcgggagctgcggcgcggcctggacagaaagagggtgctgagggacgaggatttcgaggcggacgagctgacggggatcagccctgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccattgtgcagaaccccaccagcaaaccgctgacggcgcagctgttcctggtggtgcagcacagtcgggacaacgagacttttagggaggcgctgctgaatatcaccgagcccgagggccgctggcttctggacctggtgaatattctgcagagcatcgtggtgcaggagcgcgggctgccgctgtccgagaagctggcggccatcaacttttcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcgccgcgcggtaagcgccagcaggcggcgcgagctgagcgatcaggagctgatgcacagcctgcagcgggccctgaccggggccgggaccgagggggagagctactttgacatgggcgcggacctgcactggcagcccagccgccgggtcttggaagccgcggcggtcccttacgtagaagaggtggacgatgaggatgagggcgagtacctggaagactgatggcgcgaccgtatttttgctagatgcagcaacagccacctcctgatcccgcaatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtgctggccatcgtgaacgcgctggttgagaacaaggccattcgcggcgacgaggccgggctggtgtacaacgcactgctggagcgcgtggcccgctacaacagcaccaacgtgcagaccaacctggaccgcatggtgaccgacgtgcgcgaagccgtggcccagcgcgaacggttccaccgcgagtccaacctgggatccatggtggcactgaacgccttcctcagcacgcagcccgccaacgtgccccggggccaggaggactacaccaacttcattagcgccctgcggctaatggtgaccgaggtgccccagagcgaggtgtaccagtcgggcccggactacttcttccagaccagtcgccagggcttgcagaccgtgaacctgagtcaggctttcaagaacttgcagggactgtggggcgtgcaggctccggtcggggaccgcgcgacggtgtcgagcctgctgacgccgaactcgcgcctgctgctgctgctggtggcgcccttcacggacagcggtagtatcaaccgcaactcgtacctgggctacctgattaacctgtaccgcgaggccattggccaggcgcacgtggacgagcagacctaccaggagattacccacgtgagccgcgcccttggccaggacgacccgggcaatctggaagccaccctgaacttcttgctgaccaaccggtcgcagaagatcccgccccagtacgcgctgagcgccgaggaggagcgtatattgagatacgtgcagcaaagtgtgggactgttcctgatgcaggagggggccacccccagcgccgcgctcgacatgaccgcgcgcaacatggagcccagcatgtacgccagtaatcgcccgtttattaataagctgatggactacctgcatcgggcggccgccatgaactctgactatttcaccaacgccatcctgaacccccactggctcccgccgccggggttctacacgggcgagtacgacatgcccgaccccaatgacgggtttctgtgggacgacgtggacagcagcgtgttctccccccgaccgggtgctaacgagcgccccttgtggaagaaagagggcagcgaccggcgcccgtcctcggcgctgtccggccgcacgggtgctgccgcagcggtgcccgaggccgccagtccctttccgagcttgtcactgaacagcgtccgcagtagcgagctgggcaggatcacgcgcccgcgcttgctgggcgaggaggagtacttaaataactcgctgttgaggcccgagcgggagaagaacttccccaataacgggatagagagtctggtggataagatgagccgctggaagacgtacgcgcatgagcacagggacgatccccgggcaacgcagggggccaccagccggggcagtgccgcccgtaaacgccgctggcacgacaggcagcggggactgatgtgggacgatgaggattccgccgacgacagcagcgtgttggacttgggcgggagtggtggtggtaacccgttcgctcacctgcgcccccgcgtcgggcgcctgatgtaaaaagaaaccaaaaataaatggtactcaccaaggccatggcgaccagcgtgcgttcgtttcttctctgttgtatctagtatgatgaggcgtgcgtacccggagggtcctcctccctcgtacgagagcgtgatgcagcaggcaatggcggcggcggcggcgatgcagcccccgctggaggctccttacgtgccaccgcggtacctggcgcctacggaggggcgaaacagcattcgttactcggagctggcacccttgtacgataccacccggttgtacctggtggacaacaagtcggcggacatcgcctcgctgaactaccagaacgaccacagcaactttctgaccaccgtggtgcagaacaacgatttcacccccacggaggccagcacccagaccatcaactttgacgagcgctcgcggtggggcggtcagctgaaaaccatcatgcataccaacatgcccaacgtgaacgagttcatgtacagcaacaagttcaaggcgcgggtcatggtctcccgcaagacccccaacggggtgacagtaggggatgattatgatggtagtcaggatgagctgaaatacgagtgggtggagtttgagctgcccgaaggcaacttctcggtgaccatgaccattgacctgatgaacaacgccatcatcgacaattacttggcagtggggcggcagaacggggtgctggagagcgacatcggcgtgaagttcgacacccggaacttcaggctgggttgggaccccgtgaccgagctggtcatgcccggggtgtacaccaacgaggccttccaccccgacatcgtgctgttgcccggctgcggggtggactttaccgagagccgcctcagtaatatgctgggcatccgcaagaggcagcccttccaggagggtttccagatcatgtacgaggacctggatggaggtaacatccccgcgctcttggatgtcgaggcctatgagaaaagcaaggaggagagcgtcgccgcgtcaaccgcagccgtagccaccgcctctaccgaggtccggggcgataattttgctagcgccgcagcagtggcggcggccaaggctgatgaaaccgaaagtaagatagttattcagccggtggagaaggatagcaaggataggagctacaacgtgctctcggacaagaaaaacaccgcctaccgcagctggtacctggcctacaactatggcgaccacgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcatgcccgtctactccaagagcttcttcaacgagcaggccgtctactcgcagcagctgcgcgccttcacctcgctcacgcacgtcttcaaccgcttccctgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggtctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgctcgcaactacacccccgccgccgcgcccgtctccaccgtggacgccgtcattgacagcgtggtgtccgacgcgcgccggtacgcccgcgccaagagccggcggcggcgcatcgcccggcggcaccgtagcaccaccgccatgcgtgcggcgcgagccttgctgcgcagggccaggcgcacgggacgcagggccatgctcagggcggccagacgcgcggcttcaggcgccagcgccggcaggactcggagacgcgcggccacggcggcggcagcggccatagccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggagaaggatgtccaagcgcaaattcaaggaagagatgctccaggtcatcgcgcctgagatctacggccccgcggcggcggtgaaggatgaaagaaatccccgcaaaatcaagcgggtcaaaaaggacaaaaaggaagaagatgatgtggacgatatggtagagtttgtgcgcgagtttgccccccggaggcgcgtgcagtggcgcgggcggaaagtgcgtccggtgctgagacccggcaccacggtggttttcgcgcctggcgagcggtccggcacgacatccaagcgctcctacgatgaggtgtacggggacgaggatattctcgagcaggcggccgagcgcctgggcgagtttgcttacggcaagcgcaaccgccttgcgcccctgaaggaagaggtggtgtccatcccgctggaccacggcaaccccacgccgagtcttaagcccgtgaccctgcagcaggtgctgccgagcgcggcgccgcgtcggggcttgaagcgcgagggcgaggatgtgtaccccaccatgcagctgatggtgcccaagcgccagaagctggaagacgtgctggagaccatgaaggtggacccggacgtgcagcccgaggtcaaggtgaggcccatcaagcaggtggccccgggccttggcgtgcagaccgtggacatcaagatccccacggagcccatggaaacgcagaccgaggtcgtgaagcccatcaccagcaccatggaggtgcagacggatccttggatgccggcggcgccccgaaaaccccggcgcaagtacggcgcggccagcctgctgatgcccaactacgcgctgcatccttccatcatccccacgccgggctaccgcggcacgcgcttctaccacggctataccggctcccgccgccgcaagaccaccacccgccgccgtcgtcgccgcacagctgcaactcccgctgccgccctggtgcggagagtgtaccgccgcggccgcgcgcctctgaccctgccgcgggcgcgctaccacccgagcattaccatttaactttgccgtcgcctttgcagatatggctctcacatgccgcattcgcgtccccattacgggctaccgaggaagaaaaccgcgccgtagaaggctggcgggaagcgggatgcgccgccacccccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacacttggaaattgtaataaacccgaatggactctgacgctcctggtcctgtgatgtgtttttgtagacagatggaagacatcaatttttcgtccctggctccgcgacacggcacgcggccgtttatgggcacctggagcgacatcggcaccagccaactgaacgggggcgccttcaattggagcagtctctggagcgggcttaagaattttgggtccacgcttaaaacctatggcagcaaggcgtggaacagcaccacagggcaggcgctgagagataagctgaaagagcagaacttccagcagaaggtagtcgatggcctcgcctcaggcatcaacggggtggtggacctggccaatcaggccgtgcagcggcagatcaacagccgcctggacccggttccccccgccggctccgtggagatgccgcaggtggaggaggagctgcctcccctggacaagcggggcgacaagcgtccccgtcccgacgcggaggagacgctgctgacgcacacggacgaaccgcccccgtacgaggaggcggtgaaactgggcctgcccaccacgcgtcccattgcgcctctagctaccggggtgctgaaacccgagagtagtaagcccgcgaccttggacttgcctcctccgcccactccccgcccctccacagtggctaagcccctgccgccggtggccgtggcccgcgcgcgaccgggggctcgccctcaggcgaactggcagagcactctgaacagcatcgtgggtctgggagtgcagagtgtgaagcgccgccgctgttattaaaaaacactgtagcgcttaacttgcttgtctgtgtatatgtgtatgtccgccgccgctgctgtccagaaggaggagtgaagagaaaggcgcgtcgtcgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcctacccacgatgtgaccaccgaccgcagccagcggctgacgctgcgctttgtgcccgtggaccgggaggacaacacctactcgtacaaagtgcgctacacgctggccgtgggcgacaaccgcgtgctggacatggccagcacctactttgacatccgcggcgtgctggatcggggccctagcttcaaaccctactccggcactgcctacaacagcctggctcccaagggagcgcccaacacctgccagtggaaggattctgacagcaaaatgcatacctttggggcagctgccatgcccggtgttactgggaaaaagatagaagctgatgggctgcctattagaatagattcaacttctggaactgacacagtaatttatgctgataaaactttccaaccagaaccacaagttggaaatgacagttgggttgacaccaatggtgcagaggaaaaatatggaggcagagctctaaaggacactacaaaaatgaaaccctgttatggttcattcgccaagcctaccaacaaagaaggtggtcaggctaacttaaaagattcagaacccgccgccaccactcctaactatgatatagacctggctttctttgacagcaaaactattgttgctaactacgatccagatattgtaatgtacacagaaaatgttgacttgcagactccagatactcatattgtatacaaacctggaacagaggacaccagctctgaatccaatttgggtcagcaggccatgcctaacagacccaactacattggcttcagagacaattttatcgggctcatgtactacaacagcactggcaatatgggggtgctggccggtcaggcctctcagctgaatgctgtggttgacttgcaagacagaaacactgaactgtcctaccagctcttgcttgactctctgggtgacagaacccggtatttcagtatgtggaatcaggcggtggacagctatgatcctgatgtgcgcattattgaaaaccatggtgtggaggatgaattgccaaactattgctttccgttgaatggtgtgggattgacagacacttaccagggtgttaaagttaaaacagatgcaggttctgaaaagtgggacaaagatgacaccacagttagtaatgctaatgaaatccatgtaggcaatccttttgccatggaaatcaacatccaagccaacctgtggaggaacttcctctatgccaatgttgccctctatttgcctgataaatacaaatacacaccggccaacatcaccctgcccaccaacaccaacacctacgagtacatgaacggccgggtggtggcgccctcgctggtggacgcctacattaacattggggcgcgctggtcgctggaccccatggacaacgtaaatcccttcaaccaccaccgcaatgcgggcttgcgctaccgctccatgctcctgggcaacgggcgctacgtgccattccacatccaggtgccccagaaattttttgccattaagagcctcctgctcctgcccgggtcctacacctacgagtggaacttccgcaaggacgtcaacatgatcctgcagagttcccttggcaacgacctgcgcacagacggggcctccatcaccttcaccagcattaacctctacgccaccttcttccccatggcgcacaacaccgcctccacgcttgaggccatgctgcgcaacgacaccaatgaccaatccttcaacgactacctctcggcggccaacatgctctatcccatcccggccaacgccaccaacgtgcccatctccatcccctcgcgcaactgggccgcctttcgcggctggtccttcacgcgtctcaagaccaaagagacgccctcgctgggctccgggttcgacccctacttcgtctactcgggctccatcccctacctcgacggcaccttctacctcaaccacaccttcaagaaggtctccatcaccttcgactcttccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggttaactacaaggactaccaggccgtcaccctggcctaccaacacaacaactcgggcttcgttggatacctcgcgcccactatgcgccagggccagccctaccccgccaactacccctacccgctcatcggcaagagcgccgttaccagcgtcacccagaaaaagttcatctgcgacagggtcatgtggcgcatccccttctccagcaacttcatgtccatgggcgcgctcaccgacctcggccagaacatgctctatgctaactccgcccacgcgctagacatgaatttcgaagtcgaccccatggatgagtccacccttctctatgttgtcttcgaagtcttcgacgtcgtccgagtgcaccagccccaccgcggcgtcattgaggccgtctacctgcgcacccccttctcagccggtaacgccaccacataaattcttgcttcttgcaagaagccatggccgcgggctccggcgagcaggagctcagggccatcatccgcgacctggggtgcgggccctacttcctgggcaccttcgataagcgattcccgggattcatggccccgcacaaggtggcctgcgccatcgtcaacacggccggccgcgagaccgggggcgagcattggctggccttcgcctggaacccgcgctcgaacacctgctacctcttcgaccccttcgggttctcggaccagcgcctcaagcaaatctaccagttcgagtacgagggactgctgcgccgcagcgccctggccaccaaggaccgctgcgttaccctggaaaagtccacccagaccgtgcagggtccgcgttcggccgcctgcgggcttttctgctgcatgttcctacacgccttcgtgcactggcccaaccgccccatggacaaaaatcccaccatgaacttgctgacgggggtgcccaacggcatgctccagtcgccccaggtggaacctaccctgcgccgcaaccaggaggcactctaccgcttcctcaactcccactctgcatactttcgctctcaccgcgcgcgcattgagaaggccaccgccttcgaccgcatgaatcaagacatgtaacagtgtgttttaaaatatgtttaataaacagcactttttatgtgacacatgcatttgagataattttattcttaaaaatcgaaggggttctgccgggaggtttcggcatggcccgcgggcagggacacgttgcggaactggtacttggccagccacttgaactcggggatcagcagtttcggcagcagggtgtcggggaacgagtcggtccacagcttccgcgtcagttgcagggcgcccagcaggtcgggcgcggagatcttgaaatcgcagttgggacccgcgttttgcgcgcgagagttgcggtacacagggttgcagcactggaacaccatcagggccggatgcttcacgctcgccagcaccgtagcgtcggtgatcccgtccacgtcgaggtcttcggcgttggccatcccgaagggggtcatcttgcaggtctgccggcccatggtgggcacgcagccgggcttgtggttgcaatcgcagtgcagggggatcagcatcatctgggcctggtcggcgttcatccccgggtacatggccttcatgaaagcctccagctgcttaaacgcctgctgggccttggctccctcggtgaagaagaccccgcaggacttgctagaaaactggttggtagcgcacccggcgtcgtgcacgcagcagcgcgcgtcgttgttggccagctgcaccacgctgcgcccccagcggttctgggtaatcttggcccggtcggggttctcctttagcgcgcgttgcccgttctcgcttgccacatccatctcgatcatgtgctccttctggatcatggtggtcccgtgcaggcaccgcagcttgccctcgacttcggtacagccgtgcagccacagcgcgcaccccgtgctctcccagttcttgtgggcgatctgggaatgcgcatgcacgaacccctgcaggaagcggcccatcatggtcgtcagggtcttgttactggtaaaggtcagcggaatgccgcggtgctcctcgttgatgtacaggtggcagatgcggcgatacacctcgccctgctcgggcatcagttggaagttggattttaggtcgctttccacacggtagcgctccatcagcatattcatgatttccatgcccttctcccaggccgatacaatgggcaggctcagggggttcgtcaccgccatcttagcgctagcagccttcgtcagcgggtcgttctcattgagagtctcaaagctccgcttgccgtccttctcggtgatccgcacgggggggtagctgaagcccacggccgccagctcctcctcggcctctctttcgtcctcgctgtcctggctgacgtcctgcaggggcacatgcttcgttttgcggggtttctttttgggcggctgctgcggcggcggtggttgttcctgaggcgagggggagcgcgagttctcgctcaccactactatctcttcttcttggtccgaggccacgcggcggtaggtatgtctcttcaggggcagaggcggaggcgacgggctctcgcggcccggcgggtggctggcagagccccttccgcgatcgggggtgcgctcccggcggcgctctaactgacttcctccgcggccggccattgtgttctcctagggaacaacaacaagcatggagactcagccatcgtcgccaacctcgccatctgcccccaccgccgacaagaagcagcagcagaatgagagcttaaccgccccgccgcccagccccgccacctttgtcgcggccccagacatgcaagagatggaggaatccattcagattgacctgggctatgtgacgcccgcggagcacgaggaggagcttgcagtgcgcttttcaacccaggaagagatacaccaagaacagccagagcaggaagcaaagagcgagcatgactacctccaccagagcgggggggaggacgccctcatcaagcatctggcccggcaggccatcatcgtcaaggacgcgctgcttgaccgcaccgaggtgcccctcagcgtggaggagctcagccgcgcctacgagctcaacctcttctcgccgcgcgtgccccccaagcgccagcccaacggcacctgcgagcccaacccacgcctcaacttctacccggtcttcgcggtgcccgaggccctggccacctaccacatctttttcaagaaccaaaggatccctgtctcctgtcgcgccaaccgcacccgcgccgactcccttttcaacctgggccccggtgcccgcctacctgatatcgcctccttggaagaggttcccaagatcttcgagggtctgggcagcgacgagactcgggccgcaaacgctctgcaaggagaaggaggagatcatgagcaccacagcgccctggtggagttggaaggcgacaacgcgcgtctggcggtgctcaagcgcacgatcgagctgacccatttcgcctacccggcgcttaacctgccccccaaagtcatgagcacggttatggatcaggtgctcatcaagcgcgcgtcgcccatctccaaggagatgcaagaccccgagagctccgaggagggcaagcccgtggtcagcgacgagcagctggcgcggtggctgggaccccaagctagtccccagagcttggaagagcggcgcaagctcataatggccgtggtcctggtgaccgcggagctggagtgtctgcgccgcttcttcgccgacgcagaaattctgcgcaaggtcgaggagaacctgcactacatcttcaggcacgggttcgtacgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtttacctctacctctgccacacctggcagacagccatgggcgtgtggcagcagtgtctggaggagcagaacctaaaagagctctgcaagctcctgcagaagaacctcaaggccctgtggaccgggttcgacgagcgcaccaccgcctcggacctggcagacctcattttccccgagcgtctcaggctgacgctgcgcaacggtttgcccgactttatgagtcaaagcatgttgcaaaactttcgctctttcatcctcgaacgctccgggatcctgccggccacctgctccgcgctgccctcggacttcgtgccgctgaccttccgcgagtgccccccgccgctgtggagccactgctacctgctgcgcttggccaactacctggcctaccactcggacgtgatcgaggacgtcagcagcgagggcctgctcgagtgccactgccgctgcaacctctgcacgccgcaccgctccctggcctgcaacccccagctgctgagcgagacccagatcatcggcaccttcgagttgcaagggcccggcgatgagggttctgccgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagctatccagaaatcccgccaagaattcttgctgaaaaagggccgcggggtctaccttgatccccagaccggtgaggagcttaaccccggcttcccccaggatgccccgaggaagcagcaagaagctgaaagtggagctgccgcccgtggaggatttggaggaagactgggagagcagtcaggcagaggaggaggagatggaagactgggacagcactcaggcagaggacagcctgcaagacagtctggaagacgaggaggaggcagaggaggtggaagaagtagccgccgccgccagaccgtcgtcctcggcggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaagcttgcgggggcaacatctcattcacccggcgctacctgctctttcaccgcggggtgaacttcccccgcaacatcttgcattactaccgtcacctccacagcccctactacttccaagaagaggcagaaaaagacaaaaccagcagctagaaaatccacagcggcggcggcggcaggtggactgaggatcgcggcgaacgagccggcgcagacccgggaactgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcacgcttgaggacgccgaggctctcttcaacaagtactgcgcactcactcttaaagagtagcccgcgcccgcccacacacggaaaaaggcgggaattacgtcacctgtgcacccccacccagcaccgctatgagcaaagaaattcccacgccttacatgtggagctaccagccccagatgggcctggccgccggcgccgcccaggactactccacccgcatgaattggctcagcgccgggcccgggatgatctcacgggtgaatgacatccgcgcccaccgaaaccagatactcctagaacagtcagcgctcaccgccacgccccgcaatcacctcaatccgcgtaattggcccgccgccctagtgtaccaggaaattccccagcccacgaccgtactacttccgcgagacgcccaggccgaagtccagctgactaactcaggtgtccagctggcgggcggcgccaccctgtgtcgtcaccaccccgctcagggtataaagcggctggtgatccggggcagaggcacacagctcaacgacgaggtggtgagctcttcactgggtttgcgacctgacggagtcttccaactcgccggatcgggaagatcttccttcacgcctcgtcaggccgtgctgactttggagagttcttcctcgcaacctcgctcgggcggcatcggcactctccagtttgtggaggagttcactccctcggtctacttcaaccccttctccggctcccccggccactatccggacgagttcatcccgaacttcgatgccatcagcgaatcggtagacggctacgattgaatgtcccatggtggcgcggctgacctagctcggcttcgacacctggaccactgccgccgctttcgctgcttcgctcgggacctcgccgagtttacctactttgagctgtccgaggagcaccctcagggcccggcccacggagtgcggatcgtcgtcgaagggggcctagactcccacctgcttcgtatcttcagccagcgcccgatcctggtccagcgccaacagggcaacaccctcctgaccctttactgcatctgcaaccaccccggcctgcatgaaagtctttgttgtctgctgtgtactgagtataataaaagctgagatcagcgactactccggactcgattgtgttcctgcatccctcaaccagtctctgaccttcaccgggaacgaaacagagctccatctccagtgtaagccccacaaaaagtacctcacctggctgcaccagggctccccaatcgccgttgttaaccactgcaacgacgacggagtcctgctgaacggccccgccaaccttactttttccacccgcagaagcaagctactgctcttccgacccttcctaccagggatctatcagtgcgtctcgggaccctgccatcacaccttccacctgatcccgaataccacctcttccccagcgccgctcctcactaacaaccaaactaaccaccaccaacgctaccgtcgagacctcgttgaatctaataccacccacaccggaggtgagctccgaggtcctcagtcatctgggatttattacggtccctgggaggtggtggggttaatagctttaggcttagtagcgggtgggcttttggctctttgctacctatacctcccttgcttttcctacttagtggtgctttgttgctggtttaagaaatggggaagatcaccctagtgtgcggtgtgctggtggcggtactttcgattttgggtctgggcagcgcggctgtagtgacggagaaggccgatccctgcttgacttttaaccccgacaaatgccagctgagttttcagccagatggcaatcggtgcgcggtgttgattaagtgcggatgggaatgccagagcgtggcgatccagtataaaaacaagacgcggaacaatactctcgcgtccacatggcagcccggggaccccgagtggtacaccgtctctgtccctggtgctgacggcttccttcgcacggtaaacaacacttttatttttgagcacatgtgcaataccgccatgttcatgagcaggcagtaccatatgtggcccccacggaaagagaatatcgtggtcttctccatcgcttacagcttgtgcacggtgctaatcaccgcgatcgtgtgcctgagcattcacatgctcatcgctattcgccccagaaataatgctgagaaagagaaacagccataacaccatttttttcacacacctttttcagaccatggcctctgttacagccattatttattttttgggtcttctgggatttatcaacagttttgaccataaaaacgtaactgcttatgttggttctaactgtgtactaactgggtaccagtcacaccaacgggtttcatggtactggtttgataaaaaaaacacagcttatacactttgcaaaggtaatcagcggcccacacagcgcagtggtctttattacagctgcactaataataatatcacactacttcaagtgactaaacaatattctgggacatactatggaaccaattttaacacggaacaggacacttactatagtgtcaaagtattggatccaactactcccagaactactaccaaacataccacaactaaaaagcccactatacctaaaaccactaaattaacaaccacaaccagcaccacacttgctgtgacctcacaggcaactactgaaaacgaattggttgccctgttgcagaatggggagaataatagcagcagtcctctgcctaccacccccagtgagcaaattcccagatccatgattggcattatcgctgctgtggtggtgtgtatggtcattatcatcttgtgcatgatgtactatgcctgctactacagaaaacacagactgaacaacaagctggacccctactgaattttgatttttaattacaaattaattgtggttgatcccactacacctccacccaccacaactaccacagacacacaagaacccactccagaggcagtagcagagttagcaaagcagatttatgaagattcctttgttgctaatactcccacacacctcggaccgcaatgtccagggttagtagtcagcggcatcgtcggtgtgctttgtgggttagcagttataatcatctgcatgttcatttttgcttgctgctacagaaggcttcaccgacagaaatcagacccactgctgaacctctatgtttaatttttgattttccagagccatgaaggcacttagcactttagtttttttgtccttgattggcattgtttttagtaatcctattcctagagttagctttattaaaccagttaatgttactgaagggagcaatgtgacactggtaggtgtagagggtgctaaaaacaccacctggacaaaatatcaccttaatgggtggaaagatatctgcaattggagtgtgacagtttatacatgcgagggagttaatcttaccattgtcaatgcaacctcagctcaaaatggtagaattcaagggcaaagtgttagtgattctgaggggtattatacccaacatacttttatctatgacattaaggtcataccattgccaacacccagcccacctagcactactcaaaccactacatcaactcagcccaccgccaccacaacagcagaggcatttttgttgctgccaccatctagcagtcccactgctagtaccaataagcagactactaaatttttgtccactactgaaagccacaccacagctaccttgagagccttctctagcaccgctaatcttacctcgctttcctatacattaatcagttctgttactacctctaccccagcttctcttcccactcccctgaagcaaaccgaaggcggtttgcaatggcagatcaccctactcattgtgatcggggtggtcatcctagcgatgctgctctacttcatcttctgccgccgcatccccaacgcgaaaccggtctacaagcccatcgttatcgggcagccggagccgcttcaggtggagggaggtctaaggaatcttctcttctcttttacagtatggtgatttgaactatgattcctagacagttctttatcattggtcttctctgcgcgctccaagtctgtgccaccctcgctctggtggctaatgcgagtccagactgcattggaccgttcgcctcctacgtgctctttgccttcatcacctgcatctgctgctgtagcatagtctgcctgcttattaccttcttccagttcgttgactgggtctttgtgcgcatcgcctacctgcgccaccacccccagtaccgcgaccaaagagtggcgcagctgctcaggctcatctgataagcatgcgggctttgctacttctcatgcttctactattgctagctcccctggtcgccccctttcccctcaaatcccccacccagtcccccaaagaggttcgaaactgtaaattccaagaaccctggaaattcctcaaatgctaccagctcaaatcagacatgcaccccagctggataattatcatgggaatcgtgaacatccttgcctgcaccttcttttcctttgtgatttacccccgctttgactttggttggaacgcacccgaggcgctctggctcccgcctgatcccgacacaccaccacagcagcagcaaaatcaggcacacgcaccaccaccacagcctaggccccaatacatgcccatcttaaactatgaggccgagccacaacgagccatgcttcctgctattagttacttcaatctaaccggtggagatgactgacccactcaacaacactgtcaacgacctcctggacatggacggccgcggctcggagcagcgtctcgcccaactccgcattcgccagcagcaggagagagccgtcaaggagctgcaggacgcagtggccatccaccagtgcaagaaaggcatcttctgcctggtgaagcaggccaagatctccttcgaggtcacttccaccgaccatcgcctctcctacgagctcctgcagcagcgccagaagttcacctgcctggtcggagtcaaccccatcgtcatcacccagcagtctggcgataccaagggttgcatccactgctcctgcgactcccccgagtgcgttcacaccctgatcaagaccctatgcggcctccgcgacctcctccccatgaactaatcaactaaccccttaccccattacccatccagtaaaaaaaataaagattaaagagacgatgattttgaattgatcaataaagaatcacttacttgaaatctgaaaccaggtctctgtccatgttttctgtcagcagcacttcgctcccctcttcccagctctggtactgcaggccccggcgggctgcaaacttcctccacactctgaaggggatgtcaaattcctcctgtccctcaatcttcattttttatttctattagatgtccaaaaagcgcgcgcgggtggatgatggcttcgaccccgtgtatccctacgatgcagacaacgcaccgaccgtgcccttcatcaaccctcccttcgtctcttcagatggattccaagaaaagcccctgggggtgttgtcccttaggctggccgaccctgtcaccaccaagaatggggaaattaccctcaagctgggggagggggtggaccttgacgactcgggaaaactcattgcaaacacagtaaacaaggccattgcccctctcagtttttccaacaacaccatttcccttaacatggatacccctttatacaccaaagatggaaaactatccttacaagtttctccaccattaagtatattaaaatcaacaattttgaatacattagctctagcttttggctcaggtttaggactcagtggcagcgccctggcagtacagttagcctctccacttacatttgatgataaagggaatataaagattaccctaaacaggggattgcatgttacaacaggagatgcaattgaaagcaacatcagttgggctaaaggtataaaatttgaagatggtgccatagctacaaacattggtaaggggctagagttcggaaccagtagtacagaaacaggagttaataatgcttatccaatccaagttaaacttggctctggtctcagctttgacagcacaggagccataatggctggcaataaagactatgataaattaactttgtggacaacgcctgacccatcaccaaactgtcaaatacttgcagaaaatgatgcaaaactaacactttgcttaactaagtgtgacagtcaaatactggccactgtatcagttttggttgttagaagtggaaacttaaacccaattactggcacagtaagcagtgctcaagtttttctacgttttgatgcaaatggtgttcttttaacagaacactctacactaaaaaaatactggggctacaagcaaggagatagcatagatggcactccatacaccaatgctgttggttttatgccaaattcaacagcttatccaaagacccaaagttctactactaaaaataatatagtgggtcaagtatacatgaatggagatgtttcaaaacccatgcttcttactataactcttaatggtactgatgacaccaccagtgcatactcaatgtcattttcatacacctggactaacggaagctatatcggagcaacatttggagctaactcatacaccttctcctacatagcccaacaataatcccaccctgcatgccaacccaccttttccctctatttataaatggaaactgaaacaaaaataaagttcaagtgttttattgattcaacagtttttcacaggattcgagtagttattttccctccaccctcccatctcatggaatacactatcctctccccacgcacagccttaaacatctgaatgctattggtaatggacatggttttgatctccacattccacacagtttcagagcgagacagtctcgggtcggtcaaggagatgaaaccctccgggcactcctgcatctgcacctcacagttcaacagctgagggctgtcctcggtgattggaatcacagttatctggaataagagcgatgagaatcataatccgcaaacgggatcgggcggttgtggcgcatcaggccccgcagcagtcgctgtctgcgccgctccgtcaagctgctactcaaggggtccgggtccagggactccctgcgcatgatgccaatggccctgagcatcagtcgcctggtacggcgggcgcagcagcggatgcggatctcactcaggtcggagcagtacgtgcagcacagcaccaccaagttgttcaacagtccatagttcaacgtgctccagccaaaactcatttgtggaactatgctgcccacatgtccatcgtaccagatcctgatgtaaatcaggtggcgtcccctccagaacacactgcccatgtacatgatctccttgggcatgtgcaggttcaccacctcccggtaccacatcacccgctggttgaacatgcagccctggataattctgcggaaccagatggcaagtaccgtcccgcccgccatgcagcgcagggaccccgggttctggcaatggcagtggatcacccaccgctcgcgaccgtggatcaactgggaactaaacaagtctatgttggcacagcacaggcacacgctcatgcatgtcttcagcactctcaattcctcgggggtcaggaccatatcccagggcacagggaactcttgcaggacagtgaacccggccgaacagggcaatcctcgcacggaacttacattgtgcatggacagggtatcgcaatcaggcagcaccggatgatcctccaccagagaagcgcggctctcggtctcctcacagcgaggtaaggtggccggcggttggtacggatgatggcgagataacgctaatcgtgttctggatcgtgtcatgatggagctgtttccggacattttcgtatttcacaaagcagaacctggtccgggcactgcacaccgctcgtcggcgacggtctcggcgcttcgagcgctcaatgttgaagttatagaacagccactccctcagaacgtgcagtatctcctgagcctcttgggtgatgaaaatcccatccgccctgatggctctgattacatcaaccacggtggaatgggccaaacccagccagatgatgcaattttgttgggtttcggtgacggcgggggagggaagaacaggaagaaccatgattaactttattccaaacggtctcggaacacttcaaaatgcaggtcccggaggtggcacctctcgcccccactgtgttggtggaaaataacagccaggtcaaaggtaacacggttctcgagatgttccacggtggcttccagcaaagcctccacgcgcacatccagaaacaagaggacagcgaaagcgggagcgttttctaattcctcaatcatcatattacactcctgcaccatgcctagataattttcatttttccagccttgaatgattcgtattagttcctgaggtaaatccaagccagccatgataaaaagctcgcgcagagcgccctccaccggcattcttaagcacaccctcataattccaacagattctgctcctggttcacctgtagtagattaacaagtggaatatcaattgctctgccgcaatccctaagctcctcccttagcagtaactgtatgtactcattcatatcttctccgaaatttttagccataggaccaccaggaacaagagaagggcaagccacattacagataaagcgaagtcctccccagtgagcattgccaaatgtaagattgaaataagcatgctggctagacccggtgatatcttccagataactggacagaaaatcaggcaagcaatttttaagaaaattaacaaaagaaaagtcgtctaggtgcacgtttagagcctcaggaacaacgatggaataagtgcaaggagtacgttccagcatggttagtgtttttggtgatctgtagaacaaaaaataaacatgcaatattaaaccatgctagcctggcgaacaggtggataaatcactctttccaacaccaggcaggctacagggtctccggcgcgaccattgtagaagctgacattatgattaaaaagcatcaccgacagaccttcccggtggccggcatggatgattcgagaagaagcatacactccgggaacattggcgtccgtgagtgaaaaaaagcgacctataaagccttgaggcactacaatgcttaatcttaattccagcaaagcgaccccatgcggatgaagcacaaaattggcaggtgcgtaaaaaatgtaattactccccttctgcacaggcagcaaagcccccgctccctccagaaacacatacaaaacctgagcgtccatagcttaccgagcacggcaggcgcaagagtcagagaaaaagctgagctctaacctaactgcccgcttctgtactcaatatatagccctaacctcactgacgtaaaggccaaggtctaaaaatacccgccaacacgcccagaaaccggtgacacactaaaaaaatacgtgcacttcctcaaacgcccaaactggcgtcatttccggtttcccacgctacgtcacctctcaacgactttcaaattccgtcgaccgttaaacacatcagttaccccgcccctaacgaacgccgctgtcacagccaatcagcgcgccccatccccaaattttcacgccttatttgcatattaactcacacaaaaaaaataaggtatattattgatgatg

SEQ ID NO: 579 - DNA, 35965 bp, Ad4FS NHRC#42606 from Ft Jackson, SC 04/02/03
catcatcaataatataccttatagatggaatggtgccaatatgtaaatgaggtgatttaaaaaagtgcgcgctgtgtggtgattggccgtggagtaaatggctaaaaggggtggggtaatgctaggaggtgacgtaacttatgtgggaggagttatgttgcaagttattgtgttaaatgtgacgtaaaaccaggtgtggtttaaacacggaagtagacagttttcccacgcttactgacaggatatgaggtagttttgggtggatgcaagtgaaaattctccattttcgcgcgaaaactgaatgaggaagtgaatgtctgagtcattttgcggttatgacagggtggagtatttgccgagggccgagtagactttgaccgtttacgtggaggtttcgattaccgtgttttttacctaaatttccgcgtacggtgtcaaagttcggtgtttttacgtaggtgtcagctgattgccagggtatttaaacctgtgctgttcagtcaagaggccactcttgagtgccagcgagaagagttttctcctccgcgccgtgagtcaaatttacactttgaaatatgaggcacctgagagacctgcccgatgagaaaattattatcgcttccgggagcgagattctggaactggtggtaaatgctataatgggcgacgaccatccggaaccccccaccccatttgagacaccttcgctgcacgatttgtatgatctggaggtggatgtgcccgaggacgaccccaacgaggaggcggtaaatgatttatttagcgatgccgcgctgctagctgccgaggaggctttaagccctagacacggcagaggtgataaaaagatcccctggcttaaaggggaagagatggacttgcattgctatgaggaatgcttgcccccgagcgatgatgagtacgagcaggcgatccagaacgcagcgagccagggagtgcaagccgccagcgagagctttgcactggactgcccacctttgcccggacacggctgtaagtcttgtgaatttcatcgtatgaatactggagataaagctgtgttatgtgcactttgctatatgagagcgtacaaccattgtgtttacagtaagtgtgattaagtgaactttagagggaggcagagagtagggtgactgggcaatgactggtttatttatgtatatctgttttttatataggtcccgtctctgatgcagatgatgaaacccccactacagagtccactttgttaccccctgaaattggcacgtccccacctaagaatattattagaccagttcctgtaaaagccactgggaggagagcagctgtggaatgtttggatgatttgcttcagggtggggatgaacctttggacttgtgtacccggaaacgccccagacattaagtgccacacatgtgtgtttacttggtgatgtcagtatttatagggtgtggagtgcaataaaatatgtgttgactttaagtgcgtggtttatgacttaggggaggggactttgggtatataagcaggtgcaaacctgtgtggttagctcaaagcggtatggagatttggacggtcttggaagacttttacaagactaggcagctgctagagaacgcctcgaacggagtttcttacctgtggagattttgcttcggtggcgacctagctaagctagtctataggaccaaacaggattataaggaacaatttgatgatattttaaaagagtgtcctggtctttttgacgctcttaacttgggccatcagtctcactttaaccagagaatttcaagagcccttgactttactactcctggcagaaccactgcagcagtagccttttttgcttttgttcttgacaaatggagtcaagaaacccatttcagcagggattaccagttggatttcttagcagtagctttgtggagagcatggaagtgccagcgcctgaatgcaatctccggctacttgccggtacagccgctagacactctgaggatcctaagtctccagcaaatttcccaggaacgccaacgccgccagcagcagcaggaggatcaagaagagaacccgagagccggcctggaccctccggcggaggaggaggagtagctgacctgtttcctgaactgcgccgggtgctgactaggtctttgagtggtcgggagaggggtattaagcgggagaggcatgatgagactaatcatagaactgaactaactgtgggtctaatgagccgcaagcgtccagaaacagtgtggtggcatgaggtgcagttgactggcacagatgaggtgtcagtcatgcatgagaaattttccctagaacaagttaaaacttgttggttggagcctgaggatgattgggaggtagccatcaggaattatgctaagctggctctaaggccagatagaaagtacaagattactaagcttataaatatcagaaatgcctgctacatctcagggaatggggctgaagtggagatctgtccgcaggatagagtggctttcagatgctgcatgatgaatatgtacccgggggtggtggacatggatggggtcacctttatgaacattaggtttaggggagatgggtataatgggacggtctttatggccaataccaagctgacagtgcatggctgctccttctttgggtttaataacacctgcattgaggcctggggtcatgtcggagtaagggggtgcagtttttcagccaactggatgggggtagtgggcaggaccaagagtatgctgtctgtgaaaaaatgcttgtttgagaggtgccatctgggggtgatgagcgagggcgaagccagaatccgccactgtgcctctaccgagacgggctgttttgtgctgtgcaagggcaatgccaagattaagcataatatgatctgtggagcctcggacgagcgcggctaccaaatgctaacatgcgccggtgggaacagtcatatgctggccaccgtgcatgtggcttcgcatccccgcaagccctggcctgagtttgagcacaatgtcatgaccaggtgcaatatgcatctgggggctcgccgaggcatgttaatgctctaccagtgcaacctgaattatgtgaaggtgctcttggagcccgatgccatgtccagagtaagcctgacgggggtgtttgacatgaatgtggaagtgtggaaaattttaagatatgatgaatacaagaccaggtgccgagcctgcgagtgcggagggaagcatgccaggttccagcccgtgtgtgtggatgtgacggaggacctgcgacccgatcatttggtgttgtcctgcaccgggacggagtttggctccagcggggaagaatctgactagagtaagtagtgtttggggagggggaggacctgcataaggggcagaatgactaaaatctgtgcttttctgtgtgttgcagcagcatgagcggaagcggctcctttgagggagggatattcagcccttatctgacggggcgtctcccctcctgggcgggagtacgtcaaaatgtgatgggatccacggtggacggccggcccgtgcagcctgcgaactcttcaaccctgacctatgcaaccctgagctcctcgtctgtggacgcagctgccgccgcagctgctgcttctgccgccagcgtcgtgcgcggaatggccatgggcgccggctactatggcactctggtggccaactcaagttccactaataatcccgccagcctgaatgaggagaagctgctactgctgatggcccagcttgaggccttgagccagcgtctgggcgagctgacccaacaggtggctcagctgcaggagcagacgcgggccgcggttgccacggtgaaatcaaaataaaaatcaatcaataaataaacaaacacagttgttgatttaaaaaaaaatcaaagtctaaatctttatttgatttttcgcgcacggtaggccctggaccaccggcctcgatcattgagcacccggtggattttttccaagacccggtagaggtgggattggatgttgaggtacatgggcatgagcccgtcccgggggtgaaggtagctccattgcagggcctcgtgctcgggggtggtgttgtaaatcacccagtcatagcaggggcgcagggcgtggtgttgcacaatatctttgaggaggagactgatggccacgggcagccctttggtgtaggtgtttacaaacctgttgagctgggagggatgcatgcggggggaaattaaatgcattttggcctggatctttaaattggcgatgttaccgcccagatcccgcctgggattcatgttgtgcagaaccaccagcacggtgtatccggtgcacttggggaatttgtcatgcaacttggaagggaaggcatgaaagaatttggagacgcccttgtgaccgcccaggttttccatgcactcatccatgataatggcaatgggcccgtgggcagcggcttgggcgaagacgtttcggggatcggacacatcgtagttgtggtcctgggtgagatcgtcataggccattttaataaatttggggcgaagggtgcccgattgggggacaaaggtaccctcgatcccgggggcgtagtttccctcacagatctgcatctcccatgccttgagctccgagggtggaatcatatccacctgcggggcgataaaaaaaacggtttccggagagggggagataagctgggcggaaagcaggttgcggagcagctgggacttaccgcaaccggtggggccgtagatgaccccgatgaccggctgcaggtggtagttaagggagagacagctgccgtcctcacggagaaggggcgccacctcgtttatcatctggcgcacgtgcatattctcacgcactagttccgccaggagtcgctctccgcccagtgaaaggagctcctggagcgaggcgaagttttttagcggcttaagcccgtcggccatgggcattttagaaagtgtctgttgcaggagttccaatcggtcccagagctcggtgatgtgctctacggcatctcgatccagcagacctcctcgtttcgcgggttggggcgactgcgggagtagggcgccagacgatgggcgtccagcgtggccagggtccggtccttccagggtcgaagcgtccgcttcagggtggtctccgtcacggtgaaggggtgcgcgccgggttgggcgcttgcgagggtgcgcttcaggctcatccggctggtcgagaaccgctcccgatcggcaccctgtgcgtcggccaggtagcaattgaccataagttcgtagttaagcgcctcggccgcgtggcctttggcgcggagcttacctttggaagtctgcccgcaagcgggacagagcagggacttcagggcgtagagcttgggggcaaggaagacggactcgggggcgtaggcgtccgcgccgcagtgggcgcagacggtttcgcactccacgagccaggtgaggtcgggctggtcggggtcaaaaaccagttttccaccgttctttttgatgcgtttcttacctctggtctccatgagctcgtgtccccgctgggtaacaaagaggctgtccgtgtccccgtagaccgactttatgggccggtcctcgagtgggacgccgcggtcctcgtcgtagaggaaccccgtccactctgagacgaaggcccgggtccaggccagcacaaaggaggccacgtgggaggggtagcggtcgttgtccaccagcgggtccaccttctccagtgtatgcaaacacatgtccccctcgtccacatccaggaaggtgattggtttgtaagtgtaggccacgtgaccaggggtcccggccgggggggtataaaagggggcgggcccctgctcgtcctcactgtcttccgaatcgctgttcaggagcgtcagctgttggggtaggtattccctctcaaaggcgggcatgacctccgcactcaggttgtcagtttctagaaacgaggaggatttgatattgacggtaccggcggagatgcctttcaagagcccctcgtccatctggtcagaaaaaacaatctttttgttgtcaagtttggtggcaaaggagccgtagagggcgttggaaaggagcttggcaatggagcgcatggtctggttcttttccttgtcggcgcgctccttggcggcgatgttaagttgcacgtactcgcgcgccacgcacttccattcggggaagacggtggtcagcttgtctggcacaattctgacctgccagccccggttatgcagggtgataaggtccacgctggtggccacctcgccgcgcaggggctcgttggtccagcaaaggcggccgcccttgcgcgagcagaaggggggcagggggtccagcataagctcttcgggggggtcggcatcaatggtgaagatgcctggcaggaggtcggggtcaaagtagctgatgcatgtgccaagatcgtccagagaagcttgccattcgcgcacggctagcgcgcgctcgtagggactaaggggcgtgccccagggcatggggtgtgtgagcgcggaggcgtacatgccgcagatgtcgtagacgtagaggggctcctcgaggattccgatgtaggtggggtagcagcggcccccgcggatgctggcgcgcacgtagtcatacaactcgtgcgagggggcgaggagtccggctccgagattggagcggttgggtttttcggtgcggtaaacgatctgacggaagatggcgtgggagttggaggagatggtgggtctttggaaaatgttaaagtgggcgtggggcaggccgaccgagtcgcggataaagtgggcgtaggagtcttgcagcttggcaacgagctcggcagtaacaaggacgtccagggcgcagtagtcgagggtctcttggatgatgtcatacttgagcttgcccttttgtttccacagctggcggttaagaaggaactcttcgcggtccttccagtactcttcaaggggaaacccgtcctgatcggcacggtaagagcctagcatgtagaactggttgacggccttgtaggcgcagcagcccttttccacggggagggcgtaggcctgggcggccttgcgcagggaggtgtgcgtaagggcaaaggtgtccctgaccattacctttaggaactggtacttgaagtcgatatcgtcgcagcccccatgctcccagagctggaagtccgtgcgcttcttgtaggcggggttgggcaaagcgaaagtaacatcgttaaagaggattttgcccgcgcggggcataaagttgcgagtgatgcggaaaggctggggcacctcggcccggttgttgatgacctgggcagcgagcacgatctcgtcgaagccgttaatgttgtggcccacaatgtatagttccacaaaccgcgggcggcccttgacgtggggcagtttcttgagctcctcgtaggtgagctcgtcggggtcgctaagcccgtgctgcttgagggcccagtcggcgagatgggggttggcgcggaggaaggaagtccagagatccacggccagggcggtttgtagacggtcccggtactggcgaaactgctgacccacggccattttttcgggggtgacgcaataaaaggtgcgggggtcgccgtgccagcgatcccattttagctggagggcgagatcgagggcaagcttcacaagccggtcgtccccggagagtttcatgaccagcatgaaggggacgagctgcttgccgaaggaccccatccaggtgtaggtttccacatcgtaggtaaggaagagcctttcggtgcgaggatgcgagccgatggggaagaactggatctccttccaccagttggaggaatggctgttgatgtgatgaaagtagaaatgccgacggcgcgccgaacattcgtgcttgtgtttatacaagcggccacagtgctcgcaacgctgcacgggatgcacgtgctgcacaagctgtacctgggttcctttgacgaggaatttcagtgggaagtggagttgtggtgcctgcatctggtgctgtactacgttgtggtggttggcctggccctcttctgcctcgatggtggtcatgcttacaagcccgcgcgggaggcaggtccagacctcggcgcggacgggtcgaagagcaaggacgagggcgcgcaggccggagctgtccagggacctaagacgctgcggagtcaggtcagtgggcagcggcggcgcgcggttaacttgcataagtttttccagggcgcgcgggaggtccagatggtacttgatctccaccgcgccgttagtggcgacgtcgatggcttgcagggtcccgtgcccctggggagtgaccaccgtcccctgtttcttcttggtgggcgggggcggtttggcttccatggttagaagcggcggcgaggacgcgcgccgggcggcaggggcggctcgggacctgcaggcaggggcggcaggggcacgtcggctccgcgcgcgggcaggttctggtactgcgtccggagaagactggcgtgagcgacgacgcgacggttgacgtcctggatctgtcgcctctgggtgaaggccacgggacccgtgagtttgaacctgaaagagagttcgacagaatcaatctcggtatcgttgacggcggcctgccgcaggatctcttgcacgtcgcccgagttgtcctggtaggcaatctcggtcataaactgctcaatctcctcctcctgaaggtctccgcggccggcgcgctccacggtggccgcaaggtcgttggaaatgcggcccatgagttgcgagaaggcgttcatgcccgcctcgttccagacgcggctgtaaaccacggtgccctcgggatcgcgggcgcgcataaccacctgggcaaggttaagctccacgtggcgcgcaaagaccgcgtagttgcagaggcgctggtaaaggtagttcagcgtggtggcgatgtgctcggtgacaaagaagtacataatccagcggcgaagcggcatttcgctgacgtcgcccagggcttccaagcgctccatggcctcgtaaaagtccacggcaaagttgaaaaactgggagttgcgtgccgagacggtcaactcctcctccagaagacggatgagctcggcgatggtggcgcgcacctcgcgctcaaaggcacccgggagttcctccacttcttcctcttcatccactaacatttcttgtacttccacctcaggcggtggtggcgggggagggggcctgcgtcgccggcggcgcacgggcaaacggtcgatgaaacgctcgatggtctcaccgcgccggcgtcgcatggtctcggtgacggcgcgtccgtcctcgcggggccgcagcgtaaagacgccgccgtgcatctccaggtggcctggggggtccccgttgggcagggagagggcgctaacgatgcatcttatcaattgccccgtagggactccgcgcaaggacctaagcgtctctagatccactggatctgaaaaccgttgaacgaaggtttcgagccagtcgcagtcgcaaggtaggctgagcacggtttcttctggcggcggtggggtgtgggcgggggcgatgctgctggtgataaagttaaaataggcggttctaagacggcggatggtggcgaggagcaccaggtctttgggtccggcttgctggatgcgcagacggttggccatgccccaggcgtggtcctgacacctggccaggtccttgtagtagtcctgcatgagccgctccacgggcacctcctcctcgcccgcgcggccgtgcatgcgcgtgagcccgaacccgcgctgcggctggacaagcgccaggtcagcaacgacgcgctcggcgaggatggcctgctgaatctgggtgagggtggtctggaagtcgtcaaagtcgacgaagcggtggtaggctccggtgttgatggtgtaggagcagttggccatgacggaccagttgacggtctggtgaccgggccgcgcgagctcgtggtacttgaggcgcgagtaggcacgcgagtcgaaaatgtagtcgttgcaggtgcgcaccaggtactggtagccaatgaggaagtgcggcggcggctgacggtagagcggccatcgctcggtggcgggggcgccgggcgcaaggttctcgagcatggtgcggtggtagccgtagatgtacctggacatccaggtaatgccagcggcggtggtggaggcgcgcgggaactcgcggacgcggttccaaatgttgcgcagcggcagaaagtagttcatggtgggcacggtctggcccgtaagacgcgcgcagtcgttgatgctctagacatacgggtaaaaacaaaagcggtcagcggctcgactccgtggcctggaggctaagcaaacgggttgggctgcgcgtgtaccccggttcgaatctcgaatcaggctggagccgcagctaacgtggtactggcactcccgtctcgacccaggcctgcacaaaacctccaggatacggaggcgggtcgttttgcaaatttttggcggtccaaaaaaaaaagctagtaagcacggaaagcggccgaccgcaatggctcgctgccagatttcgcagctaacgagggcgtggctgtcccgtcgtttccaagaccccataagccagccaacttctccagttacggagcgagcccctcttttgttttgtttttgccagatgcatcccgtactgcggcagatgcgcccccaccctccaccgcaacagcggccccctcctccgcaacagccggcgcttctgcctccgccccaacagcagcaacttccagtcactaccgccacggccgccgtgagcggggccgggcagagtcagtatgacctggccttggaagagggcgaggggctggcgcgcctgggggcgtcgtcgccggagcggcacccgcgcgtgcagatgaaaagggacgctcacgaggcctacgtgcccaagcagaacctgttcagagacaggagcggcgaggagcccgaggagatgcgcgcagcccgttttcacgcggggcgggagctgcggtgcggcctggaccgaaagagggtgctgagggacaaggatttcgaggcggacgagctgacggggatcagccctgcgcgcgcgcacgtggccgcggccaacctggtcacggcgtacgagcagaccgtgaaggaggagagcaacttccaaaaatccttcaacaaccacgtgcgcaccctgatagcgcgcgaggaggtgaccctgggcctgatgcacctgtgggacctgctggaggccattgtgcagaaccccaccagcaaaccgcttacggcgcagctattcctggtggtgcagcacagtcgggacaacgagactttcagggaggctctgctgaatatcaccgagcccgagggccgctggctcctggacctggtgaatattttacagagcattgtggtgcaggagcgcgggctgccgctgtccgaaaagctggcggccattaacttttcggtgctgagtctgggcaagtactatgctaggaagatatacaagactccgtacgtgcccatagacaaggaggtgaagattgacgggttttacatgcgcatgaccctgaaagtgctgaccctgagcgacgatttgggggtgtaccgcaacgacaggatgcaccgcgcggtgagcgccagtaggcggcgcgagctaagcgatcaggagctaatgcacagcctgcagcgggccctcaccggggccggaaccgatggggaaagctactttgacatgggcgcagacctgcactggcagcccagccgccgggtcttggaagccgcggcggtcccttacgtagaagaggtggacgatgaggatgagggcgagtacctggaagactgatggcgcgaccgtatttttgctagatgcagcaacagtcacctcctgatcccgcaatgcgggcggcgctgcaaagccagccgtccggcattaactcctcggacgattggacccaagccatgcaacgcatcatggcgctgacgacccgcaaccccgaagcctttagacagcagccccaggccaaccggctctcggccattttggaggccgtggtgccttcgcgctccaaccccacgcacgagaaggtgctggccattgtgaatgcgctggttgagaacaaggccatccgcggcgacgaggccgggctggtgtacaacgcgctgctggagcgcgtggcccgctacaacagcaccaacgtgcagactaacctggaccgtatggtgaccgacgtgcgcgaggccgtggcccagcgcgaacggttccaccgcgagtccaacctgggatccatggtggcgctaaatgccttcctcagcacgcagcccgccaacgtgccccggggccaggaggactacaccaactttatcagcgccctgcggctgatggtaaccgaggtaccccaaagcgaggtgtaccagtcgggcccggactactttttccagaccagtcgccagggcttgcagaccgtaaacctcagtcaggctttcaaaaacttgcagggactgtggggcgtgcaggccccggtcggggaccgcgccacggtgtcgagcctgctgacgccaaactcgcgcctgctgctgctgctggtggcgccctttacggacagcggtagtatcaaccgcaactcgtacctgggctacctgattaacctgtaccgcgaggccattggccaggcgcacgtggacgagcagacctaccaggaaattacccacgtaagccgcgccctaggccaggacgaccctggcaatctggaagccaccctaaacttcttgctgaccaaccggtcgcagaagatcccgccccagtacgcgctgagcgccgaggaggagcgcatattgagatacgtgcagcagagtgtgggactgttcctgatgcaggagggggccacccccagcgccgcgcttgacatgaccgcgcacaacatggagcccagcatgtacgccagtaatcgcccgtttattaataagctgatggactacctgcatcgggcggccgccatgaactctgactattttaccaacgccatccttaacccccactggcttccgccgccggggttctacacgggcgagtacgacatgcccgaccccaatgacgggtttttgtgggacgacgtggacagcagcgtgttctccccccgaccgggtgccaacgagcgccccttgtggaagaaagagggcagcgaccggcgcccgtcctcgacgctgtccggccgcacgggtgctgccgcggcggtgcccgaggccgccagtccctttccgagcttgccattttcgctgaacagcgtccgcagcagcgagctgggcaggatcacgcgcccgcgcttgctgggcgaggaggagtacttaaataactcgctgttaaggcccgagcgggagaaaaacttccccaataacggaatagagagtctggtggacaagatgaaccgctggaagacgtatgcgcaggagcacagggacgatccccgggcaacgcaggggaccgccagccggggcagtgccgcccgtaaacgacgctggcacgacaggcagcggggactgatgtgggacgatgaggattccgccgatgacagcagcgtgttggacttgggcgggagtggtggtggtaacccgttcgctcacctgcgcccccgcgttgggcgcctgatgtaaaaagaaaccaaaaaataaatggtacttaccaaggccatggcgaccagcgtgcgttagtttcttctctgttgtatctagtatgatgaggcgtgcgtacccggagggtcctcctccctcgtatgaaagcgtgatgcagcaggcaatggcggcggcggcggcaatacagccaccactggaggctccttacgtgccaccgcggtacctggcgcctacagaggggcgaaacagcattcgttactcggagctgacacccttgtacgataccacccggttgtacctggtggacaacaagtcggcggacatcgcctcgctgaactaccagaacgaccacagcaactttctgaccaccgtggtgcagaacaacgatttcacccccacggaggccagcacccagaccatcaactttgacgagcgctcgcggtggggcggccagctaaaaactattatgcacaccaacatgcccaacgtgaacgagttcatgtacagcaacaagttcaaggcgcgggtcatggtctctcgcaagacgcccaacggggtgacagtaggggataattatgatggtagtcaggatgagctaaaatacgagtgggtggagtttgagctgcccgaaggcaacttctcggtgaccatgaccattgacctgatgaacaacgccatcatagacaattacttggcagtgggacggcaaaacggggtgctggagagcgacattggcgtgaagttcgacacccgaaacttcaggctgggctgggaccccgtgaccgagctggtcatgcccggggtgtacaccaacgaggcatttcaccccgacattgtgctgctgcccggctgcggggtggactttaccaagagccgcctgagtaacctgctgggcattcgcaagaggcagcccttccaggagggtttccagatcatgtacgaggacctggatggaggtaacatccccgcgctcttggatgtcgaggcctatgagaaaagcaaggaggagagcgtcgccgcggcaaccacagccgtagccaccgcctctaccgaggtccgggacgataattttgctagcgccgcagcagtggcggcggttaaggctgatgaaaccaaaagtaagatagtcattcagccggtggagaaggatagcaaggagaggagctacaacgtgctttcggacaagaaaaacaccgcctaccgcagctggtatctggcctacaactatggcgaccgcgacaagggcgtgcgctcctggacactgctcaccacctcggacgtcacctgcggcgtggagcaagtctactggtcgctgcccgacatgatgcaagacccggtcaccttccgctccacgcatcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggtttgcacgcgcccagcaagatgtacggaggcgctcgccaacgctccacgcaacaccctgtgcgcgtgcgcgggcacttccgcgctccctggggcgcccttaagggccgcgtgcggtcgcgcaccaccgtcgacgacgtgatcgaccaggtggtggccgacgctcgcaactacacccccgccgccgcgcccgtctccaccgtggacgccgtcattgacagcgtggtggccgatgcgcgccggtacgcccgcgccaagagccggcggcggcgcatcgcccggcggcaccgaagcaccaccgccatgcgcgcggcgcaagcattgctgcgcagggccaggcgcacgggacgcagggccatgctcagggcggccagacgcgcggcttcaggcgccagcgccggcagaacccggagacgagcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgtttacttggcgatgttgatgtgtcccagcggcgaggagaaggatgtccaagcgcagattcaaggaagagatgctccaggtcatcgcgcctgagatctacggtcccgcggcggcggtgaaggatgaaagaaatccccgcaaaatcaagcgggtcaaaaaggacaaaaaggaagaagataatgtggacgatatggtgaagtttgtgcgcgagttcgccccccggcggcgcgtgcagtggcgcgggcggaaagtgcgtccggtgctaagacccggcaccacggtggttttcgcgcccggcgagcggtccggcactacctccaagcgctcctacgacgaggtgtacggggacgaggatattctcgagcaggcggccgagcgcctgggcgagtttgcttacggaaagcgcaaccgccttgcgcccctaaaggaagaggtggtgtccatcccgctggaccacggcaaccccacgccaagtctcaagcccgtgaccctgcagcaggtgttgccgaacgcggcgccgcgccagggcttcaagcgccagggcgaggatgtgtaccccaccatgcagctgatggtgcccaagcgccagaagctagaagacgtgctggagaccatgaaggtggacccggacgcgcagcccgaggttaaggtacgacccatcaagcaggtggccccaggcctcggcgtgcagaccgtggacatcaagatccccacggagcccatggaaacgcagacagaggtcgtgaagcccatcaccagcaccatggaggtgcagacggatccctggatgccggtggtgccccgaaaaccccggcgcaagtacggcgcgaccagcctgctaatgcccaactacgcgctgcatccttccatcatccccacgccgggctaccgcggcacacgcttctaccacggctataccagctcccggcgccgcaagaccaccacccgccgccgtcgtcgccgcacagctacaactcccgccgacgccctggtgcggagagtgtaccgccgcggccgcgcgcctctgaccctgccgcgtgcgcgctaccacccgagcattgccatttaactttgccgtcgcctttgcagatatggctctcacatgccgcattcgcgtccccattacgggctaccgaggaagaaaaccgcgccgtagaaggctggcgggaagcgggatgcgtcgccacccccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacacttggaaattgtaataaacccaaattggactctgacgctcctggtcctgtgatgtgttttcgtagacagatggaagacatcaatttttcgtccctggctccacgacacggcacgcggccgtttatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgaaagataagctaaaagagcagaacttccagcagaaggtggtggatggccttgcctcgggcatcaacggggtggtggacctggccaaccaggccgtgcagcggcagatcaacagccgcctggacccggttccccccgtcggctccgtggaggaggagctgcctcccctggacaagcggggcgacaagcgtccccgtcccgacgcggaggagacgctgctgacgcacacggacgaaccgcccccgtacgaggaggcggtaaaactgggcctgcccaccacgcgtcccatcgcgcctgtagctaccggggtgctaaatccccagagtagtaagcccgcaaccttggaattgcctcctccgcccactccccgcccctccacagtggctaagcccctgccgccggtggccgtggcccgcgcaggaccgggggctcgccctcaggcgaactggcagagcactctgaacagcatcgtgggtctgggagtgcagagtgtgaagcgccgccgctgctattaaaaaacactgtagcgcttaacttgcttgtctgtgtatatgtgtatgtccgccgccgctgctgtccagaaggaggagtgaagagaaaggcgcgtcgtcgagttgcaagatggccaccccatcgatgctgccccagtgggcgtacatgcacatcgccggacaggacgcttcggagtacctcagtccgggtctggtgcagttcgcccgcgccacagacacctacttcagtctggggaacaagtttagaaaccccacggtggcgcctacccacgatgtgaccaccgaccgcagccagcggctgacgctgcgctttgtgcccgtggaccgggaggacaacacctactcgtacaaagtgcgctacacgctggccgtgggcgacaaccgtgtgctggacatggccagcacctactttgacatccgcggcgtgctggaccggggccctagctttaaaccctactccggcactgcctacaacagtctggctcccaagggagcgcccaatacctgccagtggaaggatgctaacagcaaaatgcatacctttggggtagctgccatgccaggtgttactgggaaaaagatagaagctgatgggctgcctattagaatagattcaacttctggaactgacacagtaatttatgctgataaaactttccaaccagaaccacaagttggaaatgacagttgggttgacaccaatgatgcagaggaaaaatatggaggcagagctctaaaggacactacaaatatgaaaccctgctatggttcattcgccaagcctaccaacaaagaaggtgggcaggctaacttaaaagattcagaaaccgccgccaccactcctaactatgatatagatctggctttctttgacggcaaaaatattgttgctaactacgatccagatattgtaatgtacacagaaaatgttgacttgcagactccagatactcatattgtatacaaacctggaaaagaggacaccagctctgaatccaatttgggtcagcaggccatgcctaacagacccaactacattggctttagagacaattttattgggctcatgtactacaacagcactggcaatatgggggtactggccggtcaggcctctcagctgaatgctgtggttgacttgcaagacagaaacactgaactgtcctaccagctcttgcttgactctttaggcgacagaacccggtatttcagtatgtggaatcaggcggtggacagctatgatcctgatgtgcgcattattgaaaaccatggtgtggaggatgaattgccaaactattgctttccgttaaatggtgtgggattgacagacacttaccagggtgttaaagttaaaacagatgcaggttctgaaaagtgggacaaagatgacaccacagttagtactgctaatgaaatccatgtaggcaatccttttgccatggaaatcaacatccaagccaacctgtggaggaacttcctctatgccaatgttgccctctatttgcctgataaatacaaatacacaccggccaacatcaccctgcccaccaacaccaacacctacgagtacatgaatggccgggtggtggcgccatcgctggtggacgcctacattaacatcggagcacgctggtcgctggaccccatggacaacgtaaatcccttcaaccaccaccgtaacgcgggcttgcgctaccgctccatgcttctgggcaacgggcgctacgtgccattccacatccaggtgccccagaaatttttcgccatcaagaaccttttgctcctgcccgggtcctatacctacgagtggaacttccgcaaggacgtcaacatgatcttgcagagttcccttggcaacgacctgcgcacagacggggcctccatcaccttcaccagcatcaacctctacgctaccttcttccccatggcgcacaacaccgcctccacgcttgaggccatgctgcgcaacgacaccaatgaccagtcctttaacgactacctctcggcggccaacatgctataccccatcccggccaatgccaccaacgtgcccatctccatcccctcgcgcaactgggccgcctttcgcggctggtccttcacgcgtctcaagaccaaagagacgccctcgctgggctccgggtttgacccctactttgtctactcgggctccatcccctacctcgacggcaccttttacctcaaccacaccttcaagaaggtttcaatcaccttcgactcttccgtcagctggcccggcaacgaccggctcctgacgcccaacgagtttgaaattaagcgcaccgtggacggcgaggggtacaacgtggcccagtgcaacatgaccaaggactggttcttggtccagatgctggcccattacaacattggctaccagggcttctacgtgcccgagggctacaaggatcgcatgtactctttcttccgcaacttccagcccatgagccgccaggtggtggacgaggttaactacaaggactaccaggccgtcaccctggcctatcagcacaacaactcgggctttgtcggttacctcgcgcccaccatgcgccggggccagccctaccccgccaactacccctacccgctcattggcaaaagcgccgtcaccagcgtcacccagaaaaagttcatctgcgacagggtcatgtggcgcattcccttctccagcaacttcatgtccatgggcgcgctcaccgaccttggccagaacatgctctatgctaactccgcccacgcgctagacatgaatttcgaagtcgaccccatggatgagtctacccttctctatgttgtcttcgaagtcttcgacgtcgtccgagtgcaccagccccaccgcggcgtcatcgaggccgtctacctgcgcacccccttctcggccggtaacgccaccacataaattattgcttcttgcaagaagccatggccgcaggctccggcgagcaggagcttagggccattatccgtgacctgggatgcgggccctacttcctgggcaccttcgataagcgctttccgggattcatggccccgcacaagctggcctgcgccatcgtcaatacggccggtcgcgagaccgggggcgaacactggctggcctttgcctggaacccgcgctcgaacacctgctacctcttcgaccccttcgggttctcggacgagcgcctcaagcagatctaccagttcgagtacgagggcctgctgcgccgcagcgccctggccaccgaggatcgctgcgtcaccctggaaaagtccacccagaccgtgcagggtccgcgctcggccgcctgcgggctcttctgctgcatgttcctgcacgccttcgtgcactggcccgaccgccccatggataagaaccctaccatgaacttgctgacgggggtgcccaacggcatgctccagtcgccccaggtggaatctaccttgctccgcaaccaggaggcgctctaccgcttcctcaactcccactctgcctactttcgctgtcaccgcgcgcgcattcagaaggcaaccgcctttgaccgcatgaatcaagacatgtaacagtgtgtgttttaaaaatatgtttaataaacagcactttttatgtgacacatgcatttgagataattttattcttaaaaatcaaagggattctgccgggaggtttcggcatgacccgcgggcagggacacattgcggaactggtacttggccagccacttgaactcggggatcagcagtttcggcagcagggtgtcggggaacgaatcggtccacagcttccgtgtcagttgcagggcacccagcaggtcgggcgcggagatcttgaaatcgcagttgggacctgcgttttgcgcgcgagagttgcggtacacggggttgcagcactggaacaccatcagggccggatgcttcacgctcgccagcaccgtcgcgtcggtgatcccgtccacgtcgaggtcttcggcgttggccatcccaaagggggtcatcttgcaggtctgccggcccatggtgggcacgcagccgggcttgtggttgcaatcgcagtgcaggggaattagcatcatttgggcctgggcggcgttcatccccgggtacatggccttcatgaaagcctccagctgcttaaacgcctgctgggccttggctccctcggtaaagaagaccccgcaggacttgctagagaactgattggtagcgcacccggcgtcgtgcacgcagcagcgcgcgtcgttgttggccagctgcaccacgctgcgcccccagcggttctgggtgatcttggcccggtcggggttctccttcagcgcgcgttgtccgttttcgctcgccacatccatctcgatcatgtgctccttatggatcatggcggtcccgtgcaggcatcgcagcttgccctcgacttcggtacagccgtgcagccacagcgcgcaccctgtgctctcccagtttttatgggcgatttgggaatgcgcgtgcacgaacccctgcaggaagcggcccatcatggtcgtcagggtcttgttactggtaaaggtcagcggaatgccgcggtgctcctcgttaatgtacaggtggcagatgcggcgatacacctcgccctgctcgggcatcagttggaagttggatttcaggtcgctctccacgcggtagcgctccattagcatattcatgatttccatgcccttctcccaggccgatacaatgggcaggcttagggggttcatcaccgccatcttagcgctagcagccttcaccagggggtcgttgtcattgagagtctcaaagctccgcttgccgtccttctcggtgatccgcacggggggatagctaaagcccacggctgccagctcctcctcggcctctctttcgttctcgctgtcctggctgacgtcctgcaggggcacatgcttggttttgcggggtttcttcttgggcggcgacggcggtggttgttcctgaggcgagggggagcgcgagttttcgctcaccactactatctcttcttcttggtccgaggccatgcggcggtaggtatgtctcttcaggggcagaggcggaggcgacgggctctcgcggtccggcgggtggctggcagagccccttccgcgatcgggagtgcgctcccggcggcgctctgactgacttcctccgcggccggccattgtgttctcctagggaacaacaacaagcatggagactcagccatcgtcgccaaccttgccatctgcccccaccgccgacaacaagcagcagcagaatgagagcttaaccgccccgccgcccagccccgccatctccgacgcggccccagacatgcaagagatggaggaatccatcgagattgacctgggctatgtgacgcccgcggagcacgaggaagagcttgcagtgcgcttttcaacccaggaagagatacaccaagaacagccagagcaggaagcagagagtgagcgtgactacctccacctcagcgggggggaggacgcgctcatcaagcatctggcccgacaggccatcatcgtcaaggacgcgctgcttgaccgcaccgaggtgcccctcagcgtggaggagcttagccgcgcctacgagctcaaccttttctcgccgcgcgtgccccccaagcgccagcccaacggcacctgcgagcccaacccacgcctcaacttctacccggtctttgcggtgcccgaggccctggctacctaccacatctttttcaagaaccaaaggatccccgtctcctgtcgcgccaaccgcacccgcgccgacgcccttttcgacctgggccccggtgcccgcatacctgatatcgcctccttggaagaggttcccaagatcttcgagggtctgggcagcgacgagactcgggccgcaaacgctctgcaaggagaaggaggagagcatgagcaccacagcgccctggtggagttggaaggcgacaacgcgcgtctggcggtgctcaagcgcacgatcgagctgacccatttcgcctacccggcgctgaatcttccccccaaagtcatgagcacggttatggaccaggtgcttattaagcgcgcgtcgcccatctccaaggagatgcaagaccccgagagctccgaggagggcaagcccgtggtcagcgacgagcagctggcgcggtggctgggtccccaagctagtccccagagcttggaagagcggcgcaagctcataatggccgtggtcctggtgaccgcggagctggagtgtctgcgccgcttcttcgccgacgcagaaactttgcgtaaggtcgaggagaacctgcactacatcttcaggcacgggtttgtacgccaggcctgcaagatctccaacgtggagctgaccaacctggtctcctacatgggcatcttgcacgagaaccgcctggggcaaaacgtgctgcacaccaccctgcgcggggaggcccgccgcgactacattcgcgactgcgtctacctctacctttgccacacctggcagacggccatgggcgtgtggcagcagtgtctggaggagcaaaacctaaaagagctctgcaagctcttgcaaaagaacctcaaggccctgtggaccgggttcgacgagcgcaccaccgcctcggacctggccaacctcattttccccgagcgcctcaggctgacactgcgcaacggtttgcccgactttatgagtcaaagcatgttgcaaaactttcgctcttttattctggaacgctccgggatcctgcccgccacctgctccgcactgccctcggactttgtgccgctgaccttccgcgagtgccccccgccgctgtggagccactgctacctgctgcgcttggccaactacctggcctaccactcggacgtgatccaggacgttagcggcgagggtctgctggaatgccactgccgctgcaacctatgcacgccgcaccgctccctggtctgcaacccccagctgttaagcgagacccaaatcatcggcacctttgagttgcaagggcccggcgatgagggctctgccgccaaggggggtttaaaacttaccccggggctgtggacctcggcctacttgcgcaagtttgtgccccaggactaccatccctttgagatcaggttctacgaggaccaatcccagccgcccaaggccgagctgacagcctgcgtcatcacccagggggcgatcctggcccaattgcaagccatccaaaaatcccgccaagaattcttgctgaaaaagggccgcggggtctaccttgatccccagaccggtgaggagctcaatcccggcttcccccaggatgcccagaggaagcagcaagaagctgaaagtggagctgccgcccgtggaggatttggaggaaaactgggaaagcagtcaggcagaggaggaggagatggaagactgggacagcactcaggcagaggaggacagcctgcaagacagtctggaagacgaggaggtggaagaagcagtcgccgccagaccgtcgtcctcggcggagaaagcaagcagcacggataccatctccgctccgggtcggggtcccgctcgaccccacagtagatgggacgaaaccgggcgatttccgaaccccaccacccagaccggtaagaaggagcggcagggatacaagtcctggcgggggcacaaaaacgccatcgtatcctgcttgcaagcttgcgggggcaacatctcattcacccggcgctacctgctctttcaccgcggggtgaacttcccccgcaacgtcttgcattactaccgtcacctccacagcccctactactttgaagaagacaaaaccagcagctagaaaattcacagcggcggcagcggcaggtggactgaggatcgcggcgaacgagccggtgcagacccgggagctgaggaaccggatttttcccaccctttatgccatcttccaacagagtcgggggcaggagcaggaactaaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacaaaaaaggcgggaaatacgtcacctgtgcacccccacccagcaccgctatgagtaaagagattcccacgccttacatgtggagctaccagccccaaatgggcctggccgccggcgccgcccaggactactccacccgcatgaattggctcagcgccgggcccgggatgatctcacgggtaaatgacatccgcgcccaccgaaaccagatactcctaaaacagtcagcgctcaccgccacgccccgcaatcacctcaatccgcgtaattggcccgccaccctagtgtaccaggaaattccccaacccaccaccgtactacttcctcgagacgcccaggccgaagtccagctgactaactcaggtgtccagctggcgggcggcgccaccctatgtcgtcaccacccccctcagggtataaagcggctggtgatccggggcagaggcacacagcttaacgacgaggtggtaagctcttcactgggtctgcgacctgacggagtctttcaaatcgccggatcgggaagatcttccttcacgcctcgtcaggccgtgctaactttggaaagttcgtcctcgcaaccccgctcgggcggcatcggcactctccagtttgtggaggagttcactccttcggtctacttcaaccccttctccggctcccccggccactacccggacgagtttatccccaacttcgacgccatcagcgagtcggtggacggctacgattaaatgtcccatgctggcgcggctgacctagctcggcttcgacacctggaccactgccgccgctttcgctgcttcgctcgggaccttgtcgagttcacctactttgagctgcccgaggagcaccctcagggcccggcccacggagtgcggatcgtcatcgaagggggcctagactcccacctgcttcgtatcttcagccagcgcccaatcctggttgagcgacaacagggcaacaccctcctgaccctctactgcatctgcaaccaccccggcctgcatgaaagtctttgttgtctgctgtgtactgagtataataaaagctgagatcagcgactactccggactccattgtattcctgcatccttcaaccagtctctgaccttcaccgggaacgagaccgagctccatctccagtgtaagccccacaagaagtacctcacctggctgtaccagggcttcccgttcgccgttgttaaccactgctacaacgacggagtcctgctaaacggtcccgccaaccttactttttccacccgcagaagcaagctactgctcttccgacccttcctaccagggatatatcagtgcgtctcgggaccctgccatcacaccttccacctgatcccgaataccacctattccccagcgccgctccccactaacaaccaaactaaccaccaccaacgctaccgtcgagacctcgttgaatctaataccacccacaccggaggtgagctccgaggtcctcagtcctctgggatttattacggtccctgggaggtggtggggttaatagctttaggcttagtagcgggtgggcttttggctctttgctacctatacctcccttgcttttcctacttagtggtgctttgttgctggtttaaaaaatggggaagatcaccctagtgtgcggtgtgctggtggcggtacttttgattttgggtttgggcagcacggctgtagtgacggagaaggccgatccctgcttaacttttaaccccgacaaatgccagctgagttttcaaccagatggcaatcggtgcgcggtgttgattaagtgcgggtgggaatgcgatagcgtggtgatccattataaaaacaagacgcggaacaatactctcgcgtccacatggcagcccggggaccccgagtggtacaccgtctctgtccctggtgctgacggctccctccgcacggtgaacaacactttcatttttaagcacatgtgcaataccgccatgttcatgagcaggcagtacgatatgtggcccccacgaaaagagaacatcgtggtcttctccatcgcttacagcttgtgcacggtgctaatcaccgcgattgtgtgcctgagcattcacatgctcattgctattcgccccagaaataatgccgagaaagaaaaacagccataacaccattttttacacacctttttcagaccatggcctctgttacagcccttatttattttttgggtcttctgggctctatcagcagttttgaccataaaaacataactgcttatgttggttctaactgtgtactaactgggtaccaatcacaccaacgggtttcatggtactggtttgataaaaaaaacacagcttatacactttgcaaaggttatcatcaacccacacagcgcggtggtctttattacagctgcactaataataatatcacactacttcaagtgactaaacaatattctgggacatattatggaaccaattttaacacaaaacaggacacttattatagtgtcgaagtattggatccaactactcccagaactaaaaccactaaattaacaaccagcaccacacttgctatgactacacacactaagctgacctcacaggcaactactgaaaacgaattggttgccctgacgcaaaatggggagaatagtagtagcaatcctttgcctaccacccccagtgagaaaattcccagatccatgattggcattatcgctgctgtagtggtgtgtatggtcattatcatcttgtgcatgatgtactatgcctgctactacagaaaacacaggctgaacaacaagctagacccctactaaatgtttattttaaattttttagaaccataaagatcctaagccttttttgtttttctataatttttacctctgctatttgtgaatcagtggataaggacgttactgtcacactggaggcagtagcagattcatgaagattcctttgttgctaatactcccacacaccccggaccgcaatgtccagggttagtagttagcagttataatcatgtgcatgttcatttttgcttgctgctacagaaggcttcatcggcagaaatcagacccactgctgaacctctatgtttaattttgattttccagaaccaatgaatgcacttagcactttagtttttttgaccttgattggctttgttttcagtaatcctattcctagagttagctttattaaactagttaatgttactgaagggggcaatgtaatactggtaggtgtagagggtgctaaaaacaccacttggacaaaatatcaccttaatgggtggaaaaatatctgcaattggagtgtaacagtttatacatgcgagggagttaatcttatcattgccaatgcaacctcagctcaaaatggtagaattcaagggcaaagtgttagtgattctaatgggtattatacccaacatacttttatttatgacattaaggttataccactgccaacacccagcccacctagcactacattaactgagcccaccaccgccacaacagcagaggcaagcagttcgtctaggatccaaatggcatttttgttgccaccatctagcagtcccactgctagtaccaataagcagtctactaaatttttgtccattactaaaagccacaccacagctacctcgagagccttctctagcaccgctaatctcacttcgctttcctctaccccagcttcttttcccactcccctaaagcaaacccaaggcggcttgcaatggcagatcaccctgctcattgtaatcggggttgtcctcctggcggtgctgctctacttcatcttttgccgccgcatccccaacgcgaaaccggtctacaagcccattgttatcgggcagccggagccgcttcaggtggatggaggtctaaggaatcttcttttctcttttacagtatggtgatttgaactatgattcctagacagttctttatcattggtcttctctgtgcgctccaagtctgtgccaccctcgctttggtggctaacgcaagtccagactgcattggaccgttcgcctcctacgtgctctttgcctttatcacctgcatctgctgttgtagcatagtctgcctgcttatcaccttcttccagttcgttgactgggtctttgtgcgcattgcctacctgcgccaccacccccagtaccgcgaccaaagagtggcgcagctgcttaggcttatttgacaatcatgcgggctttgctacttctcacgcttttgctattgctagctcccctggttgccccctttcccctcaaatcccccacccagtcccccaaagaggttcgaaaatgtaaattccaagaaccctggaaattcctcaaatgctaccagctcaaatcagacatgcaccccagctggataattatcatgggaatcgtgaacatccttgcctgcaccctcttttcctttgtgatttacccccgctttgattttggttggaacgcacccaaggcgctttggctcccgcctgctcccgacacaccaccacagcagcagcaaaatcaggcacacgcaccaccaccacagcctaggccgcaatacatgcccatcttagattatgaggccgagccacagcaagccatgcttcctgctattagctacttcaatctaaccggtgaagatgactgacccactgaacaacaccgtcaacgacctcctggacatggacggccgcggctcggagcagcgcctcgcccaactccgtattcgccagcagcaggagagagccgtcaaggagctgcaggacgcagtggccatccaccagtgcaagaaaggcatcttctgcctggtgaagcaggccaagatatccttcgaggtcacttccaccgaccatcgcctttcctacgagctcctgcagcagcgccagaagttcacctgcctggtcggagttaaccccatcgtcatcacccagcagtctggcgataccaagggttgcatccactgttcctgcaactcctccgagtgcgtttacaccctgatcaagaccctctgcggcctccgcgacctcctccccataaactaaccccattacccatccagtaaaaaataaggatgatgattttgaattgatcaataaagaattacttacttgaaatctgaaaccaagtctctgtccatgttttctgtcagcagcacttcactcccctcttcccagctctggtactgcaggccccggcgggctgcaaacttcctccacactctgaaggggatgtcaaattcatcctgtccctcaatcttcatttttattttttattagatgtccaaaaagcgcgcgcgggtggatgatggcttcgaccccgtgtacccctacgatgcagacaacgcaccgaccatgcccttcatcaaccctcccttcgtctcttcagatggattccaagaaaagcccctgggggtgttgtcccttaggctggccgaccctgtcaccaccaagaatggggaaatcaccctcaatctgggggagggggtggaccttgacgactcgggaaaactcattgcaaacacagtcaacaaggccattgcccctcttagtttttccaacaacaccatttcccttaacatggatacccctttatacaccaaagatggaaaactatccttacaagtttctccaccattaagtatattaagatcaacaattctaaatacattagctctagcttttggctcaggtttaggactgcgtggcagcgctctggcagtacagttagcctctccacttacatttgatgataaagggaatataaagattaccctaaataggggattgcatgttacaacaggaaatgcaattgaaagcaacattagttgggctaaaggtataaaatttgaagatggtgccatagctacaaacattggtaaggggctagagtttggaaccagtagtacagaaacaggagttaataatgcttatccaatccaagttaaacttggatctggtctcagctttgacagcacaggagctataatggctggcaaaaaagactatgataaattaactttgtggacaacgcctgacccatcaccaaactgtcaaatacttgcagaaaatgatgcaaaactaacactttgcttaactaagtgtgacagtcaaatactggccactgtatcagttttggttgttagaagtggaaacttaaacccaattactggcacagtaagcagtgctcaagtttttctacgttttgatgcaaacggtgttcttttaacagaacactctacactaaaaaaatactggggctacaggcaaggagatagcatagatggcactccatacaccaatgctgttggtttcatgccaaattcaacagcttatccaaagacccaaagttctactactaaaaataatatagtgggacaagtatacatgaatggagatgtttcaaaacccatgcttcttactataactcttaatggtactgatgacaccaccagtgcatactcaatttcattttcatacacctggactaacggaagctatatcggagcaacatttggagctaactcatacaccttctcctacatagcccaagaataatcccacactgcatgccaacccacctttttcctttatctataaatggaaactgaaacaaaaataaagtttaagtgttttattgattcaacatttttttacaggattcgagtagttattttccctccaccctcccaactcatggaatacactatcctctccccacgcacagccttaaacatctgaatgccattggtaatggacatggttttggtctccacattccacacagtttcaaagcgagacaatctcgggtcggtcaaggagatgaaaccctccgggaactcctgcatctgcacctcacagtttaacagctgagggctgtcctcggtggttggaatcacagttatctggaataagagcgatgagaatcataatccgcgaacgggatcgggcggttgtggcgcattaggccccgcaacagtcgctgtctacgccgctccgtcaagctgctgctcaaggggtccgggtcctgggactccctgcgcatgatgccaatggccctaagcatcagtcgcctggtacggcgggcacagcagcggatgcgaatctcacttaggtcaaagcagtacgtacagcacagcaccaccacgttgttcaacagtccatagtttaacgtgctccagccaaaactcatctgtggaactatgctgcccacatgtccatcgtaccagattctgatgtaaatcaggtggcgccccctccagaacacactgcccatgtacatgatctccttgggcatgtgcaggtttactacctcccggtaccacatcacccgctggttaaacatgcagccctggataatcctgcggaaccagatggccagcactgccccgcccgccatgcagcgcaaagaccccgggtcctggcaatggcagtggatcacccaccgctcacggccgtggattaactgggaactaaacaagtctatgttggcacagcacaggcacacgctcatgcatgtcttcagcactctcaattccttgggggtcaggaccatatcccagggcacagggaactcttgcaggacagtaaagccggccgaacagggcaatcctcgcacggaacttacattgtgcatagacagggtatcgcaatcaggcagcaccggatgatcctccaccagagaagcgcggctctcggtctcctcacagcgaggtaaggtggccggcggttggtacggatgatggcaagataacgctaatcgtgttctggatcgtgtcatgatggagctgtttccggacattttcgtattttacgaagcagaacctggtccgggcactgcacaccgctcgtcggcgacggtctcggcgctttgagcgctcgatgttgaagttatagaacagccactcccttaaaacgtgcagtatctcctcagcctcttgggtgatgaaaatcccatttgccctaatggctctaatcacatcgaccacggtggaatgggccagacccagccagatgatgcaattttgttgggtttcgataacggcgggggagggaagaacaggaagaaccatgattaattttattccaaacggtctcggaacacttcaaaatgcaggtcccggaggtggcacctctcgcccccactgtgttggtggaaaataacagccaggtcaaaggtgacacggttctcgagatgttccacggtggcttccagcaaagcctccacgcgcacatccagaaacaagaggacagcaaaagcgggagcgttttctaattcctcaatcatcatattacactcctgcaccatccctagataattttcatttttccagccttgaatgattcgtattagttcctgaggtaaatccaagccagccatgataaaaagctcgcgcagagcgccctccaccggcattcttaagcacaccctcataattccaagagatcctgctcctggttcacctgtagcagattaacaagtggaatatcaattgctctgccgcaatccctaagctcctccctcagcagtaactgtatgtactcattcatatcttctcctaaatttttagccataggactgccaggaataagagaagggcaagccacattacagataaagcgaagtcctccccagtgagcattgccaaatgtaagattgaaataagcatgctggccagactcggtgatatcttccagataactggacagaaaatcaggcaagtaatttttaagaaaatcaacaaaagaaaagtcgtctaggtgcatgtttagagcctcaggaacaacgatggaataagtgcaaggagtgcgttccagcatggttagtgtttttggtgatctgtagaacaaaaaataaacatgcaatattaaaccatgctagcctggcgaacaggtggataaatcactttttccaacaccagacaggctacagggtctccggcgcgaccactgtagaagctgacattatgattaaaaagcatcaccgagagaccttcccggtggccggcatggataatttgagaagaagcatacactccgggaacattggcgtccgtgagtgaaaaaaagcggcctataaagcctcgaggcactacaatgcttaatcttaattccagcaaagcgaccccatgcggataaagcacaaaattggcaggtgcgtaaaaaatgtaattacttcccttctgctcaggcagcaaagcccccgctccctccagaaacacatacaaaacctcagcgtccatagcttaccgagcacggcaggcgcaacagtcaaagaaaaagctcagctctaacctaattgtccgcttttgtgctcaatatatagccctaacctacactgacgtaaaggccaaggtctaaaaatacccgccaacacgcccagaaaccggtgacacactaaaaaaatacgtacacttcctcaaacacccatactggcgttatttccgggttcccacgctacgtcacctttaaacgacttttaaattccgttgaccgttaaacacatcagttatccgcccctaacagtcgccgctgttacgcccaattagcgcgcctattcccaaatttaataatggtgtttaaaccacacctggttttacgtcacatttaacacaataacttgcaacataactcctcccacataagttacgtcacctcctagcattaccccaccccttttagccatttactccacggccaatcaccacacagcgcgcacttttttaaatcacctcatttacatattggcaccattccatctataaggtatattattgatgatg

SEQ ID NO: 580 - DNA, 35964 bp, Ad4FS from Brooks AFB, Lackland AFB AF#3 2002
catcatcaataatataccttatagatggaatggtgccaatatgtaaatgaggtgatttaaaaaagtgcgcgctgtgtggtgattggccgtggagtaaatggctaaaaggggtggggtaatgctgggaggtgacgtaacttatgtgggaggagttatgttgcaagttattgtgttaaatgtgacgtaaaaccaggtgtggtttaaacacggaagtagacagttttcccacgcttactgacaggatatgaggtagttttgggtggatgcaagtgaaaattctccattttcgcgcgaaaactgaatgaggaagtgaatgtctgagtcattttgcggttatgacagggtggagtatttgccgagggccgagtagactttgaccgtttccgtggaggtttcgattaccgtgtttttacctaaatttccgcgtacggtgtcaaagttcggtgtttttacgtaggtgtcagctgattgccagggtatttaaacctgtgctgttcagtcaagaggccactcttgagtgccagcgagaagagttttctcctccgcgccgtgagtcaaatttacactttgaaatatgaggcacctgagagacctgcccgatgagaaaattattatcgcttccgggagcgagattctggaactggtggtaaatgctataatgggcgacgaccatccggaaccccccaccccatttgagacaccttcgctgcacgatttgtatgatctggaggtggatgtgcccgaggacgaccccaacgaggaggcggtaaatgatttatttagcgatgccgcgctgctagctgccgaggaggctttaagccctagacacggcagaggtgataaaaagatcccctggcttaaaggggaagagatggacttgcattgctatgaggaatgcttgcccccgagcgatgatgagtacgagcaggcgatccagaacgcagcgagccagggagtgcaagccgccagcgagagctttgcactggactgcccacctttgcccggacacggctgtaagtcttgtgaatttcatcgtatgaatactggagataaagctgtgttatgtgcactttgctatatgagagcgtacaaccattgtgtttacagtaagtgtgattaagtgaactttagagggaggcagagagtagggtgactgggcaatgactggtttatttatgtatatctgttttttatataggtcccgtctctgatgcagatgatgaaacccccactacagagtccactttgttaccccctgaaattggcacgtccccacctaagaatattattagaccagttcctgtaaaagccactgggaggagagcagctgtggaatgtttggatgatttgcttcagggtggggatgaacctttggacttgtgtacccggaaacgccccagacattaagtgccacacatgtgtgtttacttggtgatgtcagtatttatagggtgtggagtgcaataaaatatgtgttgactttaagtgcgtggtttatgacttaggggaggggactttgggtatataagcaggtgcaaacctgtgtggttagctcaaagcggtatggagatttggacggtcttggaagacttttacaagactaggcagctgctagagaacgcctcgaacggagtttcttacctgtggagattttgcttcggtggcgacctagctaagctagtctataggaccaaacaggattataaggaacaatttgatgatattttaaaagagtgtcctggtctttttgacgctcttaacttgggccatcagtctcactttaaccagagaatttcaagagcccttgactttactactcctggcagaaccactgcagcagtagccttttttgcttttgttcttgacaaatggagtcaagaaacccatttcagcagggattaccagttggatttcttagcagtagctttgtggagagcatggaagtgccagcgcctgaatgcaatctccggctacttgccggtacagccgctagacactctgaggatcctaagtctccagcaaatttcccaggaacgccaacgccgccagcagcagcaggaggatcaagaagagaacccgagagccggcctggaccctccggcggaggaggagtagctgacctgtttcctgaactgcgccgggtgctgactaggtctttgagtggtcgggagaggggtattaagcgggagaggcatgatgagactaatcatagaactgaactaactgtgggtctaatgagccgcaagcgtccagaaacagtgtggtggcatgaggtgcagatgactggcacagatgaggtgtcagtcatgcatgagaaattttccctagaacaagttaaaacttgttggttggagcctgaggatgattgggaggtagccatcaggaattatgctaagctggctctaaggccagatagaaagtacaagattactaagcttataaatatcagaaatgcctgctacatctcagggaatggggctgaagtggagatctgtccgcaggatagagtggctttcagatgctgcatgatgaatatgtacccgggggtggtggacatggatggggtcacctttatgaacattaggtttaggggagatgggtataatgggacggtcttatggccaataccaagctgacagtgcatggctgctccttctttgggtttaataacacctgcattgaggcctggggtcatgtcggagtaagggggtgcagtttttcagccaactggatgggggtagtgggcaggaccaagagtatgctgtctgtgaaaaaatgcttgtttgagaggtgccatctgggggtgatgagcgagggcgaagccagaatccgccactgtgcctctaccgagacgggctgttttgtgctgtgcaagggcaatgccaagattaagcataatatgatctgtggagcctcggacgagcgcggctaccaaatgctaacatgcgccggtgggaacagtcatatgctggccaccgtgcatgtggcttcgcatccccgcaagccctggcctgagtttgagcacaatgtcatgaccaggtgcaatatgcatctgggggctcgccgaggcatgttaatgctctaccagtgcaacctgaattatgtgaaggtgctcttggagcccgatgccatgtccagagtaagcctgacgggggtgtttgacatgaatgtggaagtgtggaaaattttaagatatgatgaatacaagaccaggtgccgagcctgcgagtgcggagggaagcatgccaggttccagcccgtgtgtgtgaatgtgacggaggacctgcgacccgatcatttggtgttgtcctgcaccgggacggagtttggctccagcggggaagaatctgactagagtaagtagtgtttggggagggggaggatctgcataaggggcagaatgactaaaatctgtgcttttctgtgtgttgcagcagcatgagcggaagcggctcctttgagggagggatattcagcccttatctgacggggcgtctcccctcctgggcgggagtacgtcaaaatgtgatgggatccacggtggacggccggcccgtgcagcctgcgaactcttcaaccctgacctatgcaaccctgagctcctcgtctgtggacgcagctgccgccgcagctgctgcttctgccgccagcgtcgtgcgcggaatggccatgggcgccggctactatggcactctggtggccaactcaagttccactaataatcccgccagcctgaatgaggagaagctgctactgctgatggcccagcttgaggccttgagccagcgtctgggcgagctgacccaacaggtggctcagctgcaggagcagacgcgggccgcggttgccacggtgaaatcaaaataaaaatcaatcaataaataaacaaacacagttgttgatttaaaaaaaaaatcaaagtctaaatctttatttgatttttcgcgcacggtaggccctggaccaccggcctcgatcattgagcacccggtggattttttccaagacccggtagaggtgggattggatgttgaggtacatgggcatgagcccgtcccgggggtgaaggtagctccattgcagggcctcgtgctcgggggtggtgttgtaaatcacccagtcatagcaggggcgcagggcgtggtgttgcacaatatctttgaggaggagactgatggccacgggcagccctttggtgtaggtgtttacaaacctgttgagctgggagggatgcatgcggggggaaattaaatgcattttggcctggatctttaaattggcgatgttaccgcccagatcccgcctgggattcatgttgtgcagaaccaccagcacggtgtatccggtgcacttggggaatttgtcatgcaacttggaagggaaggcatgaaagaatttggagacgcccttgtgaccgcccaggttttccatgcactcatccatgataatggcaatgggcccgtgggcagcggcttgggcgaagacgtttcggggatcggacacatcgtagttgtggtcctgggtgagatcgtcataggccattttaataaatttggggcgaagggtgcccgattgggggacaaaggtaccctcgatcccgggggcgtagtttccctcacagatctgcatctcccatgccttgagctccgagggtggaatcatatccacctgcggggcgataaaaaaaacggtttccggagagggggagataagctgggcggaaagcaggttgcggagcagctgggacttaccgcaaccggtggggccgtagatgaccccgatgaccggctgcaggtggtagttgagggagagacagctgccgtcctcacggagaaggggcgccacctcgtttatcatctggcgcacgtgcatattctcacgcactagttccgccaggagtcgctctccgcccagtgaaaggagctcctggagcgaggcgaagttttttagcggcttaagcccgtcggccatgggcattttagaaagtgtctgttgcaggagttccaatcggtcccagagctcggtgatgtgctctacggcatctcgatccagcagacctcctcgtttcgcgggttggggcgactgcgggagtagggcgccagacgatgggcgtccagcgtggccagggtccggtccttccagggtcgaagcgtccgcttcagggtggtctccgtcacggtgaaggggtgcgcgccgggttgggcgcttgcgagggtgcgcttcaggctcatccggctggtcgagaaccgctcccgatcggcaccctgtgcgtcggccaggtagcaattgaccataagttcgtagttaagcgcctcggccgcgtggcctttggcgcggagcttacctttggaagtctgcccgcaagcgggacagagcagggacttcagggcgtagagcttgggggcaaggaagacggactcgggggcgtaggcgtccgcgccgcagtgggcgcagacggtttcgcactccacgagccaggtgaggtcgggctggtcggggtcaaaaaccagttttccaccgttctttttgatgcgtttcttacctctggtctccatgagctcgtgtccccgctgggtaacaaagaggctgtccgtgtccccgtagaccgactttatgggccggtcctcgagtgggacgccgcggtcctcgtcgtagaggaaccccgtccactctgagacgaaggcccgggtccaggccagcacaaaggaggccacgtgggaggggtagcggtcgttgtccaccagcgggtccaccttctccagtgtatgcaaacacatgtccccctcgtccacatccaggaaggtgattggtttgtaagtgtaggccacgtgaccaggggtcccggccgggggggtataaaagggggcgggcccctgctcgtcctcactgtcttccgaatcgctgttcaggagcgtcagctgttggggtaggtattccctctcaaaggcgggcatgacctccgcactcaggttgtcagtttctagaaacgaggaggatttgatattgacggtaccggcggagatgcctttcaagagcccctcgtccatctggtcagaaaaaacaatctttttgttgtcaagtttggtggcaaaggagccgtagagggcgttggaaaggagcttggcaatggagcgcatggtctggtttttttccttgtcggcgcgctccttggcggcgatgttaagttgcacgtactcgcgcgccacgcacttccattcggggaagacggtggtcagcttgtctggcacaattctgacctgccagccccggttatgcagggtgataaggtccacgctggtggccacctcgccgcgcaggggctcgttggtccagcaaaggcggccgcccttgcgcgagcagaaggggggcagggggtccagcataagctcttcgggggggtcggcatcaatggtgaagatgcctggcaggaggtcggggtcaaagtagctgatgcatgtgccaagatcgtccagagaagcttgccattcgcgcacggctagcgcgcgctcgtagggactaaggggcgtgccccagggcatggggtgtgtgagcgcggaggcgtacatgccgcagatgtcgtagacgtagaggggctcctcgaggattccgatgtaggtggggtagcagcggcccccgcggatgctggcgcgcacgtagtcatacaactcgtgcgagggggcgaggagtccggctccgagattggagcggttgggtttttcggtgcggtaaacgatctgacggaagatggcgtgggagttggaggagatggtgggtctttggaaaatgttaaagtgggcgtggggcaggccgaccgagtcgcggataaagtgggcgtaggagtcttgcagcttggcaacgagctcggcagtaacaaggacgtccagggcgcagtagtcgagggtctcttggatgatgtcatacttgagcttgcccttttgtttccacagctggcggttgagaaggaactcttcgcggtccttccagtactcttcaaggggaaacccgtcctgatcggcacggtaagagcctagcatgtagaactggttgacggccttgtaggcgcagcagcccttttccacggggagggcgtaggcctgggcggccttgcgcagggaggtgtgcgtaagggcgaaggtgtccctgaccattacctttaggaactggtacttgaagtcgatatcgtcgcagcccccatgctcccagagctggaagtccgtgcgcttcttgtaggcggggttgggcaaagcgaaagtaacatcgttaaagaggattttgcccgcgcggggcataaagttgcgagtgatgcggaaaggctggggcacctcggcccggttgttgatgacctgggcagcgagcacgatctcgtcgaagccgttaatgttgtggcccacaatgtatagttccacaaaccgcgggcggcccttgacgtggggcagtttcttgagctcctcgtaggtgagctcgtcggggtcgctaagcccgtgctgcttgagggcccagtcggcgagatgggggttggcgcggaggaaggaagtccagagatccacggccagggcggtttgtagacggtcccggtactggcgaaactgctgacccacggccattttttcgggggtgacgcaataaaaggtgcgggggtcgccgtgccagcgatcccattttagctggagggcgagatcgagggcaagcttcacaagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctccttccaccagttggaggaatggctgttgatgtgatgaaagtagaaatgccgacggcgcgccgaacattcgtgcttgtgtttatacaagcggccacagtgctcgcaacgctgcacgggatgcacgtgctgcacaagctgtacctgggttcctttgacgaggaatttcagtgggaagtggagttgtggtgcctgcatctggtgctgtactacgttgtggtggttggcctggccctcttctgcctcgatggtggtcatgcttacaagcccgcgcgggaggcaggtccagacctcggcgcggacgggtcgaagagcaaggacgagggcgcgcaggccggagctgtccagggacctaagacgctgcggagtcaggtcagtgggcagcggcggcgcgcggttaacttgcataagtttttccagggcgcgcgggaggtccagatggtacttgatctccaccgcgccgttagtggcgacgtcgatggcttgcagggtcccgtgcccctggggagtgaccaccgtcccctgtttcttcttggtgggcgggggcggtttggcttccatggttagaagcggcggcgaggacgcgcgccgggcggcaggggcggctcgggacctgcaggcaggggcggcaggggcacgtcggctccgcgcgcgggcaggttctggtactgcgtccggagaagactggcgtgagcgacgacgcgacggttgacgtcctggatctgtcgcctctgggtgaaggccacgggacccgtgagtttgaacctgaaagagagttcgacagaatcaatctcggtatcgttgacggcggcctgccgcaggatctcttgcacgtcgcccgagttgtcctggtaggcaatctcggtcataaactgctcgatctcctcctcctgaaggtctccgcggccggcgcgctccacggtggccgcaaggtcgttggaaatgcggcccatgagttgcgagaaggcgttcatgcccgcctcgttccagacgcggctgtaaaccacggtgccctcgggatcgcgggcgcgcataaccacctgggcaaggttaagctccacgtggcgcgcaaagaccgcgtagttgcagaggcgctggtaaaggtagttcagcgtggtggcgatgtgctcggtgacaaagaagtacataatccagcggcgaagcggcatttcgctgacgtcgcccagggcttccaagcgctccatggcctcgtaaaagtccacggcaaagttgaaaaactgggagttgcgtgccgagacggtcaactcctcctccagaagacggatgagctcggcgatggtggcgcgcacctcgcgctcaaaggcacccgggagttcctccacttcttcctcttcatccactaacatttcttgtacttccacctcaggcggtggtggcgggggagggggcctgcgtcgccggcggcgcacgggcaaacggtcgatgaaacgctcgatggtctcaccgcgccggcgtcgcatggtctcggtgacggcgcgtccgtcctcgcggggccgcagcgtaaagacgccgccgtgcatctccaggtggcctggggggtccccgttgggcagggagagggcgctgacgatgcatcttatcaattgccccgtagggactccgcgcaaggacctaagcgtctctagatccactggatctgaaaaccgttgaacgaaggtttcgagccagtcgcagtcgcaaggtaggctgagcacggtttcttctggcggcggtggggtgtgggcgggggcgatgctgctggtgataaagttaaaataggcggttctaagacggcggatggtggcgaggagcaccaggtctttgggtccggcttgctggatgcgcagacggttggccatgccccaggcgtggtcctgacacctggccaggtccttgtagtagtcctgcatgagccgctccacgggcacctcctcctcgcccgcgcggccgtgcatgcgcgtgagcccgaacccgcgctgcggctggacaagcgccaggtcagcaacgacgcgctcggcgaggatggcctgctgaatctgggtgagggtggtctggaagtcgtcaaagtcgacgaagcggtggtaggctccggtgttgatggtgtaggagcagttggccatgacggaccagttgacggtctggtgaccgggccgcgcgagctcgtggtacttgaggcgcgagtaggcacgcgagtcgaaaatgtagtcgttgcaggtgcgcaccaggtactggtagccaatgaggaagtgcggcggcggctgacggtagagcggccatcgctcggtggcgggggcgccgggcgcaaggttctcgagcatggtgcggtggtagccgtagatgtacctggacatccaggtaatgccagcggcggtggtggaggcgcgcgggaactcgcggacgcggttccaaatgttgcgcagcggcagaaagtagttcatggtgggcacggtctggcccgtaagacgcgcgcagtcgttgatgctctagacatacgggtaaaaacaaaagcggtcagcggctcgactccgtggcctggaggctaagcaaacgggttgggctgcgcgtgtaccccggttcgaatctcgaatcaggctggagccgcagctaacgtggtactggcactcccgtctcgacccaggcctgcacaaaacctccaggatacggaggcgggtcgttttgcaaatttttggcggtccaaaaaaaaaaaaagctagtaagcacggaaagcggccgaccgcaatggctcgctgccaaatttcgcagctaacgagggcgtggctgtcccgtcgtttccaagaccccataagccagccaacttctccagttacggagcgagcccctcttttgttttgtttttgccagatgcatcccgtactgcggcagatgcgcccccaccctccaccgcaacagcagccccctcctccgcaacagccggcgcttctgcctccgccccaacagcagcaacttccagtcactaccgccacggccgccgtgagcggggccgggcagagtcagtatgacctggccttggaagagggcgaggggctggcgcgcctgggggcgtcgtcgccggagcggcacccgcgcgtgcagatgaaaagggacgctcacgaggcctacgtgcccaagcagaacctgttcagagacaggagcggcgaggagcccgaggagatgcgtgcagcccgttttcacgcggggcgggagctgcggtgcggcctggaccgaaagagggtgctgagggacaaggatttcgaggcggacgagctgacggggatcagccctgcgcgcgcgcacgtggccgcggccaacctggtcacggcgtacgagcagaccgtgaaggaggagagcaacttccaaaaatccttcaacaaccacgtgcgcaccctgatagcgcgcgaggaggtgaccctgggcctgatgcacctgtgggacctgctggaggccattgtgcagaaccccaccagcaaaccgcttacggcgcagctattcctggtggtgcagcacagtcgggacaacgagactttcagggaggctctgctgaatatcaccgagccagagggccgctggctcctggacctggtgaatattttacagagcattgtggtgcaggagcgcgggctgccgctgtccgagaagctggcggccattaacttttcggtgctgagtctgggcaagtactatgctaggaagatatacaagactccgtacgtgcccatagacaaggaggtgaagattgacgggttttacatgcgcatgaccctgaaagtgctgaccctgagcgacgatttgggggtgtaccgcaacgacaggatgcaccgcgcggtgagcgccagtaggcggcgcgagctaagcgatcaggagctaatgcacagcctgcagcgggccctcaccggggccggaaccgatggggaaagctactttgacatgggcgcagacctgcactggcagcccagccgccgggtcttggaagccgcggcggtcccttacgtagaagaggtggacgatgaggatgagggcgagtacctggaagactgatggcgcgaccgtatttttgctagatgcagcaacagtcacctcctgatcccgcaatgcgggcggcgctgcaaagccagccgtccggcattaactcctcggacgattggacccaagccatgcaacgcatcatggcgctgacgacccgcaaccccgaagcctttagacagcagccccaggccaaccggctctcggccattttggaggccgtggtgccttcgcgctccaaccccacgcacgagaaggtgctggccattgtgaatgcgctggttgagaacaaggccatccgcggcgacgaggccgggctggtgtacaacgcgctgctggagcgcgtggcccgctacaacagcaccaacgtgcagactaacctggaccgtatggtgaccgacgtgcgcgaggccgtggcccagcgcgaacggttccaccgcgagtccaacctgggatccatggtggcgctaaatgccttcctcagcacgcagcccgccaacgtgccccggggccaggaggactacaccaactttatcagcgccctgcggctgatggtaaccgaggtaccccaaagcgaggtgtaccagtcgggcccggactactttttccagaccagtcgccagggcttgcagaccgtaaacctcagtcaggctttcaaaaacttgcagggactgtggggcgtgcaggccccggtcggggaccgcgccacggtgtcgagcctgctgacgccaaactcgcgcctgctgctgctgctggtggcgccctttacggacagcggtagtatcaaccgcaactcgtacctgggctacctgattaacctgtaccgcgaggccattggccaggcgcacgtggacgagcagacctaccaggaaattacccacgtaagccgcgccctaggccaggacgaccctggcaatctggaagccaccctaaacttcttgctgaccaaccggtcgcagaagatcccgccccagtacgcgctgagcgccgaggaggagcgcatattgagatacgtgcagcagagtgtgggactgttcctgatgcaggagggggccacccccagcgccgcgcttgacatgaccgcgcacaacatggagcccagcatgtacgccagtaatcgcccgtttattaataagctgatggactacctgcatagggcggccgccatgaactctgactattttaccaacgccatccttaacccccactggcttccgccgccggggttctacacgggcgagtacgacatgcccgaccccaatgacgggtttttgtgggacgacgtggacagcagcgtgttctccccccgaccgggtgccaacgagcgccccttgtggaagaaagagggcagcgaccggcgcccgtcctcgacgctgtccggccgcacgggtgctgccgcggcggtgcccgaggccgccagtccctttccgagcttgccattttcgctgaacagcgtccgcagcagcgagctgggcaggatcacgcgcccgcgcttgctgggcgaggaggagtacttaaataactcgctgttaaggcccgagcgggagaaaaacttccccaataacggaatagagagtctggtggacaagatgaaccgctggaagacgtatgcgcaggagcacagggacgatccccgggcaacgcaggggaccgccagccggggcagtgccgcccgtaaacgacgctggcacgacaggcagcggggactgatgtgggacgatgaggattccgccgacgacagcagcgtgttggacttgggcgggagtggtggtggtaacccgttcgctcacctgcgcccccgcgttgggcgcctgatgtaaaaagaaaccaaaaaataaatggtacttaccaaggccatggcgaccagcgtgcgttagtttcttctctgttgtatctagtatgatgaggcgtgcgtacccggagggtcctcctccctcgtatgaaagcgtgatgcagcaggcaatggcggcggcggcggcaatacagccaccactggaggctccttacgtgccaccgcggtacctggcgcctacagaggggcgaaacagcattcgttactcggagctgacacccttgtacgataccacccggttgtacctggtggacaacaagtcggcggacatcgcctcgctgaactaccagaacgaccacagcaactttctgaccaccgtggtgcagaacaacgatttcacccccacggaggccagcacccagaccatcaactttgacgagcgctcgcggtggggcggccagctaaaaactattatgcacaccaacatgcccaacgtgaaccagttcatgtacagcaacaagttcaaggcgcgggtcatggtctctcgcaagacgcccaacggggtgacagtaggggataattatgatggtagtcaggatgagctaaaatacgagtgggtggagtttgagctgcccgaaggcaacttctcggtgaccatgaccattgacctgatgaacaacgccatcatagacaattacttggcagtgggacggcaaaacggggtgctggagagcgacattggcgtgaagttcgacacccgaaacttcaggctgggctgggaccccgtgaccgagctggtcatgccaggggtgtacaccaacgaggcatttcaccccgacattgtgctgctgcccggctgcggggtggactttaccgagagccgcctgagtaacctgctgggcattcgcaagaggcagcccttccaggagggtttccagatcatgtacgaggacctggatggaggtaacatccccgcgctcttggatgtcgaggcctatgagaaaagcaaggaggagagcgtcgccgcggcaaccacagccgtagccaccgcctctaccgaggtccgggacgataattttgctagcgccgcagcagtggcggcggttaaggctgatgaaaccaaaagtaagatagtcattcagccggtggagaaggatagcaaggagaggagctacaacgtgctctcggacaagaaaaacaccgcctaccgcagctggtatctggcctacaactatggcgaccgcgacaagggcgtgcgctcctggacactgctcaccacctcggacgtcacctgcggcgtggagcaagtctactggtcgctgcccgacatgatgcaagacccggtcaccttccgctccacgcatcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggtttgcacgcgcccagcaagatgtacggaggcgctcgccaacgctccacgcaacaccctgtgcgcgtgcgcgggcacttccgcgctccctggggcgcccttaagggccgcgtgcggtcgcgcaccaccgtcgacgacgtgatcgaccaggtggtggccgacgctcgcaactacacccccgccgccgcgcccgtctccaccgtggacgccgtcattgacagcgtggtggccgatgcgcgccggtacgcccgcgccaagagccggcggcggcgcatcgcccggcggcaccgaagcaccaccgccatgcgcgcggcgcaagcattgctgcgcagggccaggcgcacgggacgcagggccatgctcagggcggccagacgcgcggcttcaggcgccagcgccggcagaacccggagacgagcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgtttacttggcgatgttgatgtgtcccagcggcgaggagaaggatgtccaagcgcagattcaaggaagagatgctccaggtcatcgcgcctgagatctacggtcccgcggcggcggtgaaggatgaaagaaatccccgcaaaatcaagcgggtcaaaaaggacaaaaaggaagaagataatgtggacgatatggtgaagtttgtgcgcgagttcgccccccggcggcgcgtgcagtggcgcgggcggaaagtgcgtccggtgctaagacccggcaccacggtggttttcgcgcccggcgagcggtccggcactacctccaagcgctcctacgacgaggtgtacggggacgaggatattctcgagcaggcggccgagcgcctgggcgagtttgcttacggaaagcgcaaccgccttgcgcccctaaaggaagaggtggtgtccatcccgctggaccacggcaaccccacgccaagtctcaagcccgtgaccctgcagcaggtgttgccgaacgcggcgccgcgccagggcttcaagcgccagggcgaggatgtgtaccccaccatgcagctgatggtgcccaagcgccagaagctagaagacgtgctggagaccatgaaggtggacccggacgcgcagcccgaggttaaggtacgacccatcaagcaggtggccccaggcctcggcgtgcagaccgtggacatcaagatccccacggagcccatggaaacgcagacagaggtcgtgaagcccatcaccagcaccatggaggtgcagacggatccctggatgccggtggtgccccgaaaaccccggcgcaagtacggcgcgaccagcctgctaatgcccaactacgcgctgcatccttccatcatccccacgccgggctaccgcggcacacgcttctaccacggctataccagctcccggcgccgcaagaccaccacccgccgccgtcgtcgccgcacagctacaactcccgccgacgccctggtgcggagagtgtaccgccgcggccgcgcgcctctgaccctgccgcgtgcgcgctaccacccgagcattgccatttaactttgccgtcgcctttgcagatatggctctcacatgccgcattcgcgtccccattacgggctaccgaggaagaaaaccgcgccgtagaaggctggcgggaagcgggatgcgtcgccacccccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacacttggaaattgtaataaacccaaatggactctgacgctcctggtcctgtgatgtgttttcgtagacagatggaagacatcaatttttcgtccctggctccacgacacggcacgcggccgtttatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagagataagctaaaagagcagaacttccagcagaaggtggtggatggccttgcctcgggcatcaacggggtggtggacctggccaaccaggccgtgcagcggcagatcaacagccgcctggacccggttccccccgtcggctccgtggaggaggagctgcctcccctggacaagcggggcgacaagcgtccccgtcccgacgcggaggagacgctgctgacgcacacggacgaaccgcccccgtacgaggaggcggtaaaactgggcctgcccaccacgcgtcccatcgcgcctgtagctaccggggtgctaaatccccagagtagtaagcccgcaaccttggaattgcctcctccgcccactccccgcccctccacagtggctaagcccctgccgccggtggccgtggcccgcgcaggaccgggggctcgccctcaggcgaactggcagagcactctgaacagcatcgtgggtctgggagtgcagagtgtgaagcgccgccgctgctattaaaaaacactgtagcgcttaacttgcttgtctgtgtatatgtgtatgtccgccgccgctgctgtccagaaggaggagtgaagagaaaggcgcgtcgtcgagttgcaagatggccaccccatcgatgctgccccagtgggcgtacatgcacatcgccggacaggacgcttcggagtacctcagtccgggtctggtgcagttcgcccgcgccacagacacctacttcagtctggggaacaagtttagaaaccccacggtggcgcctacccacgatgtgaccaccgaccgcagccagcggctgacgctgcgcttcgtgcccgtggaccgggaggacaacacctactcgtacaaagtgcgctacacgctggccgtgggcgacaaccgtgtgctggacatggccagcacctactttgacatccgcggcgtgctggaccggggccctagctttaaaccctactccggcactgcctacaacagtctggctcccaagggagcgcccaatacctgccagtggaaggatgctaacagcaaaatgcatacctttggggtagctgccatgccaggtgttactgggaaaaagatagaagctgatgggctgcctattagaatagattcaacttctggaactgacacagtaatttatgctgataaaactttccaaccagaaccacaagttggaaatgacagttgggttgacaccaatgatgcagaggaaaaatatggaggcagagctctaaaggacactacaaatatgaaaccctgctatggttcattcgccaagcctaccaacaaagaaggtgggcaggctaacttaaaagattcagaaaccgccgccaccactcctaactatgatatagatctggctttctttgacggcaaaaatattgttgctaactacgatccagatattgtaatgtacacagaaaatgttgacttgcagactccagatactcatattgtatacaaacctggaaaagaggacaccagctctgaatccaatttgggtcagcaggccatgcctaacagacccaactacattggcttcagagacaattttatcgggctcatgtactacaacagcactggcaatatgggggtactggccggtcaggcctctcagctgaatgctgtggttgacttgcaagacagaaacactgaactgtcctaccagctcttgcttgactctttaggcgacagaacccggtatttcagtatgtggaatcaggcggtggacagctatgatcctgatgtgcgcattattgaaaaccatggtgtggaggatgaattgccaaactattgctttccgttaaatggtgtgggattgacagacacttaccagggtgttaaagttaaaacagatgcaggttctgaaaagtgggacaaagatgacaccacagttagtactgctaatgaaatccatgtaggcaatccttttgccatggaaatcaacatccaagccaacctgtggaggaacttcctctatgccaatgttgccctctatttgcctgataaatacaaatacacaccggccaacatcaccctgcccaccaacaccaacacctacgagtacatgaatggccgggtggtggcgccatcgctggtggacgcctacattaacatcggagcacgctggtcgctggaccccatggacaacgtaaatcccttcaaccaccaccgtaacgcgggcttgcgctaccgctccatgcttctgggcaacgggcgctacgtgccattccacatccaggtgccccagaaatttttcgccatcaagaaccttttgctcctgcccgggtcctatacctacgagtggaacttccgcaaggacgtcaacatgatcttgcagagttcccttggcaacgacctgcgcacagacggggcctccatcaccttcaccagcatcaacctctacgctaccttcttccccatggcgcacaacaccgcctccacgcttgaggccatgctgcgcaacgacaccaatgaccagtcctttaacgactacctctcggcggccaacatgctataccccatcccggccaatgccaccaacgtgcccatctccatcccctcgcgcaactgggccgcctttcgcggctggtccttcacgcgtctcaagaccaaagagacgccctcgctgggctccgggtttgacccctactttgtctactcgggctccatcccctacctcgacggcaccttttacctcaaccacaccttcaagaaggtttcaatcaccttcgactcttccgtcagctggcccggcaacgaccggctcctgacgcccaacgagtttgaaattaagcgcaccgtggacggcgaggggtacaacgtggcccagtgcaacatgaccaaggactggttcttggtccagatgctggcccattacaacattggctaccagggcttctacgtgcccgagggctacaaggatcgcatgtactctttcttccgcaacttccagcccatgagccgccaggtggtggacgaggttaactacaaggactaccaggccgtcaccctggcctatcagcacaacaactcgggctttgtcggttacctcgcgcccaccatgcgccggggccagccctaccccgccaactacccctacccgctcattggcaaaagcgccgtcaccagcgtcacccagaaaaagttcatctgcgacagggtcatgtggcgcattcccttctccagcaacttcatgtccatgggcgcgctcaccgaccttggccagaacatgctctatgctaactccgcccacgcgctagacatgaatttcgaagtcgaccccatggatgagtctacccttctctatgttgtcttcgaagtcttcgacgtcgtccgagtgcaccagccccaccgcggcgtcattgaggccgtctacctgcgcacccccttctcggccggtaacgccaccacataaattattgcttcttgcaagaagccatggccgcaggctccggcgagcaggagcttagggccattatccgtgacctgggatgcgggccctacttcctgggcaccttcgataagcgctttccgggattcatggccccgcacaagctggcctgcgccatcgtcaatacggccggtcgcgagaccgggggcgaacactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggatcgctgcgtcaccctggaaaagtccacccagaccgtgcagggtccgcgctcggccgcctgcgggctcttctgctgcatgttcctgcacgccttcgtgcactggcccgaccgccccatggataagaaccctaccatgaacttgctgacgggggtgcccaacggcatgctccagtcgccccaggtggaatctaccttgctccgcaaccaggaggcgctctaccgcttcctcaactcccactctgcctactttcgctgtcaccgcgcgcgcattcagaaggcaaccgccttcgaccgcatgaatcaagacatgtaacagtgtgtgttttaaaaatatgtttaataaacagcactttttatgtgacacatgcatttgagataattttattcttaaaaatcaaagggattctgccgggaggtttcggcatgacccgcgggcagggacacattgcggaactggtacttggccagccacttgaactcggggatcagcagtttcggcagcagggtgtcggggaacgaatcggtccacagcttccgtgtcagttgcagggcacccagcaggtcgggcgcggagatcttgaaatcgcagttgggacctgcgttttgcgcgcgagagttgcggtacacggggttgcagcactggaacaccatcagggccggatgcttcacgctcgccagcaccgtcgcgtcggtgatcccgtccacgtcgaggtcttcggcgttggccatcccaaagggggtcatcttgcaggtctgccggcccatggtgggcacgcagccgggcttgtggttgcaatcgcagtgcaggggaattagcatcatttgggcctgggcggcgttcatccccgggtacatggccttcatgaaagcctccagctgcttaaacgcctgctgggccttggctccctcggtaaagaagaccccgcaggacttgctagagaactgattggtagcgcacccggcgtcgtgcacgcagcagcgcgcgtcgttgttggccagctgcaccacgctgcgcccccagcggttctgggtgatcttggcccggtcggggttctccttcagcgcgcgttgtccgttttcgctcgccacatccatctcgatcatgtgctccttatggatcatggcggtcccgtgcaggcatcgcagcttgccctcgacttcggtacagccgtgcagccacagcgcgcaccctgtgctctcccagtttttatgggcgatttgggaatgcgcgtgcacgaacccctgcaggaagcggcccatcatggtcgtcagggtcttgttactggtaaaggtcagcggaatgccgcggtgctcctcgttaatgtacaggtggcagatgcggcgatacacctcgccctgctcgggcatcagttggaagttggatttcaggtcgctctccacgcggtagcgctccattagcatattcatgatttccatgcccttctcccaggccgatacaatgggcaggcttagggggttcatcaccgccatcttagcgctagcagccttcaccagggggtcgttgtcattgagagtctcaaagctccgcttgccgtccttctcggtgatccgcacggggggatagctaaagcccacggctgccagctcctcctcggcctctctttcgttctcgctgtcctggctgacgtcctgtaggggcacatgcttggttttgcggggtttcttcttgggcggcgacggcggtggttgttcctgaggcgagggggagcgcgagttttcgctcaccactactatctcttcttcttggtccgaggccatgcggcggtaggtatgtctcttcaggggcagaggcggaggcgacgggctctcgcggtccggcgggtggctggcagagccccttccgcgatcgggagtgcgctcccggcggcgctctgactgacttcctccgcggccggccattgtgttctcctagggaacaacaacaagcatggagactcagccatcgtcgccaaccttgccatctgcccccaccgccgacaacaagcagcagcagaatgagagcttaaccgccccgccgcccagccccgccatctccgacgcggccccagacatgcaagagatggaggaatccatcgagattgacctgggctatgtgacgcccgcggagcacgaggaagagcttgcagtgcgcttttcaacccaggaagagatacaccaagaacagccagagcaggaagcagagagtgagcgtgactacctccacctcagcgggggggaggacgcgctcatcaagcatctggcccgacaggccatcatcgtcaaggacgcgctgcttgaccgcaccgaggtgcccctcagcgtggaggagcttagccgcgcctacgagctcaaccttttctcgccgcgcgtgccccccaagcgccagcccaacggcacctgcgagcccaacccacgcctcaacttctacccggtctttgcggtgcccgaggccctggctacctaccacatctttttcaagaaccaaaggatccccgtctcctgtcgcgccaaccgcacccgcgccgacgcccttttcgacctgggccccggtgcccgcatacctgatatcgcctccttggaagaggttcccaagatcttcgagggtctgggcagcgacgagactcgggccgcaaacgctctgcaaggagaaggaggagagcatgagcaccacagcgccctggtggagttggaaggcgacaacgcgcgtctggcggtgctcaagcgcacgatcgagctgacccatttcgcctacccggcgctgaatcttccccccaaagtcatgagcacggttatggaccaggtgcttattaagcgcgcgtcgcccatctccaaggagatgcaagaccccgagagctccgaggagggcaagcccgtggtcagcgacgagcagctggcgcggtggctgggtccccaagctagtccccagagcttggaagagcggcgcaagctcataatggccgtggtcctggtgaccgcggagctggagtgtctgcgccgcttcttcgccgacgcagaaactttgcgcaaggtcgaggagaacctgcactacatcttcaggcacgggtttgtacgccaggcctgcaagatctccaacgtggagctgaccaacctggtctcctacatgggcatcttgcacgagaaccgcctggggcaaaacgtgctgcacaccaccctgcgcggggaggcccgccgcgactacattcgcgactgcgtctacctctacctttgccacacctggcagacggccatgggcgtgtggcaacagtgtctggaggagcaaaacctgaaagagctctgcaagctcttgcaaaagaacctcaaggccctgtggaccgggttcgacgagcgcaccaccgcctcggacctggccaacctcattttccccgagcgcctcaggctgacactgcgcaacggtttgcccgactttatgagtcaaagcatgttgcaaaactttcgctcttttattctggaacgctccgggatcctgcccgccacctgctccgcactgccctcggactttgtgccgctgaccttccgcgagtgccccccgccgctgtggagccactgctacctgctgcgcttggccaactacctggcctaccactcggacgtgatccaggacgttagcggcgagggtctgctggaatgccactgccgctgcaacctatgcacgccgcaccgctccctggtctgcaacccccagctgttaagcgagacccaaatcatcggcacctttgagttgcaagggcccggcgatgagggctctgccgccaaggggggtttaaaacttaccccggggctgtggacctcggcctacttgcgcaagtttgtgccccaggactaccatccctttgagatcaggttctacgaggaccaatcccagccgcccaaggccgagctgacagcctgcgtcatcacccagggggcgatcctggcccaattgcaagccatccaaaaatcccgccaagaattcttgctgaaaaagggccgcggggtctaccttgatccccagaccggtgaggagctcaatcccggcttcccccaggatgcccagaggaagcagcaagaagctgaaagtggagctgccgcccgtgaaggatttggaggaaaactgggaaagcagtcaggcagaggaggaggagatggaagactgggacagcactcaggcagaggaggacagcctgcaagacagtctggaagacgaggaggtggaagaagcagtcgccgccagaccgtcgtcctcggcggagaaagcaagcagcacggataccatctccgctccgggtcggggtcccgctcgaccccacagtagatgggacgaaaccgggcgatttccgaaccccaccacccagaccggtaagaaggagcggcagggatacaagtcctggcgggggcacaaaaacgccatcgtatcctgcttgcaagcttgcgggggcaacatctcattcacccggcgctacctgctctttcaccgcggggtgaacttcccccgcaacgtcttgcattactaccgtcacctccacagcccctactactttgaagaagacaaaaccagcagctagaaaattcacagcggcggcagcggcaggtggactgaggatcgcggcgaacgagccggtgcagacccgggagctgaggaaccggatttttcccaccctttatgccatcttccaacagagtcgggggcaggagcaggaactaaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacaaaaaaggcgggaaatacgtcacctgtgcacccccacccagcaccgctatgagtaaagagattcccacgccttacatgtggagctaccagccccaaatgggcctggccgccggcgccgcccaggactactccacccgcatgaattggctcagcgccgggcccgggatgatctcacgggtaaatgacatccgcgcccaccgaaaccagatactcctaaaacagtcagcgctcaccgccacgccccgcaatcaccttaatccgcgtaattggcccgccaccctagtgtaccaggaaattccccaacccaccaccgtactacttcctcgagacgcccaggccgaagtccagctgactaactcaggtgtccagctggcgggcggcgccaccctatgtcgtcaccacccccctcagggtataaagcggctggtgatccggggcagaggcacacagcttaacgacgaggtggtaagctcttcactgggtctgcgacctgacggagtctttcaaatcgccggatcgggaagatcttccttcacgcctcgtcaggccgtgctaactttggaaagttcgtcctcgcaaccccgctcgggcggcatcggcactctccagtttgtggaggagttcactccttcggtctacttcaaccccttctccggctcccccggccactacccggacgagtttatccccaacttcgacgccatcagcgagtcggtggacggctacgattgaatgtcccatgctggcgcggctgacctagctcggcttcgacacctggaccactgccgccgctttcgctgcttcgctcgggaccttgtcgagttcacctactttgagctgcccgaggagcaccctcagggcccggcccacggagtgcggatcgtcatcgaagggggcctagactcccacctgcttcgtatcttcagccagcgcccaatcctggttgagcgacaacagggcaacaccctcctgaccctctactgcatctgcaaccaccccggcctgcatgaaagtctttgttgtctgctgtgtactgagtataataaaagctgagatcagcgactactccggactccattgtattcctgcatccttcaaccagtctctgaccttcaccgggaacgagaccgagctccatctccagtgtaagccccacaagaagtacctcacctggctgtaccagggcttcccgttcgccgttgttaaccactgctacaacgacggagtcctgctaaacggtcccgccaaccttactttttccacccgcagaagcaagctactgctcttccgacccttcctaccagggatatatcagtgcgtctcgggaccctgccatcacaccttccacctgatcccgaataccacctattccccagcgccgctccccactaacaaccaaactaaccaccaccaacgctaccgtcgagacctcgttgaatctaataccacccacaccggaggtgagctccgaggtcctcagtcctctgggatttattacggtccctgggaggtggtggggttaatagctttaggcttagtagcgggtgggcttttggctttttgctacctatacctcccttgcttttcctacttagtggtgctttgttgctggtttaaaaaatggggaagatcaccctagtgtgcggtgtgctggtggcggtacttttgattttgggtttgggcagcacggctgtagtgacggagaaggccgatccctgcttaacttttaaccccgacaaatgccagctgagttttcaaccagatggcaatcggtgcgcggtgttgattaagtgcgggtgggaatgcgatagcgtggtgatccattataaaaacaagacgcggaacaatactctcgcgtccacatggcagcccggggaccccgagtggtacaccgtctctgtccctggtgctgacggctccctccgcacggtgaacaacactttcatttttaagcacatgtgcaataccgccatgttcatgagcaggcagtacgatatgtggcccccacgaaaagagaacatcgtggtcttctccatcgcttacagcttgtgcacggtgctaatcaccgcgattgtgtgcctgagcattcacatgctcattgctattcgccccagaaataatgccgagaaagaaaaacagccataacaccattttttacacacctttttcagaccatggcctctgttacagcccttatttattttttgggtcttctgggctctatcagcagttttgaccataaaaacataactgcttatgttggttctaactgtgtactaactgggtaccaatcacaccaacgggtttcatggtactggtttgataaaaaaaacacagcttatacactttgcaaaggttatcatcaacccacacagcgcggtggtctttattacagctgcactaataataatatcacactacttcaagtgactaaacaatattctgggacatattatggaaccaattttaacacaaaacaggacacttattatagtgtcgaagtattggatccaactactcccagaactaaaaccactaaattaacaaccagcaccacacttgctatgactacacacactaagctgacctcacaggcaactactgaaaacgaattggttgccctgacgcaaaatggggagaatagtagtagcaatcctttgcctaccacccccagtgagaaaattcccagatccatgattggcattatcgctgctgtagtggtgtgtatggtcattatcatcttgtgcatgatgtactatgcctgctactacagaaaacacaggctgaacaacaagctggacccctactaaatgtttattttaaattttttagaaccataaagatcctaagccttttttgtttttctataatttttacctctgctatttgtgaatcagtggataaggacgttactgtcacactggaggcagtagcagattcatgaagattcctttgttgctaatactcccacacaccccggaccgcaatgtccagggttagtagttagcagttataatcatgtgcatgttcatttttgcttgctgctacagaaggcttcatcggcagaaatcagacccactgctgaacctctatgtttaatttttgattttccagaaccaatgaatgcacttagcactttagtttttttgacattgattggctttgttttcagtaatcctattcctagagttagctttattaaactagttaatgttactgaagggggcaatgtaatactggtaggtgtagagggtgctaaaaacaccacttggacaaaatatcaccttaatgggtggaaaaatatctgcaattggagtgtaacagtttatacatgcgagggagttaatcttatcattgccaatgcaacctcagctcaaaatggtagaattcaagggcaaagtgttagtgattctaatgggtattatacccaacatacttttatttatgacattaaggttataccactgccaacacccagcccacctagcactacattaactgagcccaccaccgccacaacagcagaggcaagcagttcgtctaggatccaaatggcatttttgttgccaccatctagcagtcccactgctagtaccaataagcagtctactaaatttttgtccattactaaaagccacaccacagctacctcgagagccttctctagcaccgctaatctcacttcgctttcctctaccccagcttcttttcccactcccctaaagcaaacccaaggcggcttgcaatggcagatcaccctgctcattgtaatcggggttgtcctcctggcggtgctgctctacttcatcttttgccgccgcatccccaacgcgaaaccggtctacaagcccatcgttatcgggcagccggagccgcttcaggtggatggaggtctaaggaatcttcttttctcttttacagtatggtgatttgaactatgattcctagacagttctttatcattggtcttctctgtgcgctccaagtctgtgccaccctcgctttggtggctaacgcaagtccagactgcattggaccgttcgcctcctacgtgctctttgcctttatcacctgcatctgctgttgtagcatagtctgcctgcttatcaccttcttccagttcgttgactgggtctttgtgcgcattgcctacctgcgccaccacccccagtaccgcgaccaaagagtggcgcagctgcttaggcttatttgacaatcatgcgggctttgctacttctcacgcttttgctattgctagctcccctggttgccccctttcccctcaaatcccccacccagtcccccaaagaggttcgaaaatgtaaattccaagaaccctggaaattcctcaaatgctaccagctcaaatcagacatgcaccccagctggataattatcatgggaatcgtgaacatccttgcctgcaccctcttttcctttgtgatttacccccgctttgattttggttggaacgcacccaaggcgctttggcttccgcctgctcccgacacaccaccacagcagcagcaaaatcaggcacacgcaccaccaccacagcctaggccgcaatacatgcccatcttagattatgaggccgagccacagcaagccatgcttcctgctattagctacttcaatctaaccggtgaagatgactgacccactgaacaacaccgtcaacgacctcctggacatggacggccgcggctcggagcagcgcctcgcccaactccgtattcgccagcagcaggagagagccgtcaaggagctgcaggacgcagtggccatccaccagtgcaagaaaggcatcttctgcctggtgaagcaggccaagatatccttcgaggtcacttccaccgaccatcgcctttcctacgagctcctgcagcagcgccagaagttcacctgcctggtcggagttaaccccatcgtcatcacccagcagtctggcgataccaagggttgcatccactgttcctgcaactcctccgagtgcgtttacaccctgatcaagaccctctgcggcctccgcgacctcctccccataaactaaccccattacccatccagtaaaaaataaggatgatgattttgaattgatcaataaagaattacttacttgaaatctgaaaccaagtctctgtccatgttttctgtcagcagcacttcactcccctcttcccagctctggtactgcaggccccggcgggctgcaaacttcctccacactctgaaggggatgtcaaattcatcctgtccctcaatcttcatttttattttttattagatgtccaaaaagcgcgcgcgggtggatgatggcttcgaccccgtgtacccctacgatgcagacaacgcaccgaccatgcccttcatcaaccctcccttcgtctcttcagatggattccaagaaaagcccctgggggtgttgtcccttaggctggccgaccctgtcaccaccaagaatggggaaatcaccctcaatctgggggagggggtggaccttgacgactcgggaaaactcattgcaaacacagtcaacaaggccattgcccctcttagtttttccaacaacaccatttcccttaacatggatacccctttatacaccaaagatggaaaactatccttacaagtttctccaccattaagtatattaagatcaacaattctaaatacattagctctagcttttggctcaggtttaggactgcgtggcagcgctctggcagtacagttagcctctccacttacatttgatgataaagggaatataaagattaccctaaataggggattgcatgttacaacaggaaatgcaattgaaagcaacattagttgggctaaaggtataaaatttgaagatggtgccatagctacaaacattggtaaggggctagagtttggaaccagtagtacagaaacaggagttaataatgcttatccaatccaagttaaacttggatctggtctcagctttgacagcacaggagctataatggctggcaataaagactatgataaattaactttgtggacaacgcctgacccatcaccaaactgtcaaatacttgcagaaaatgatgcaaaactaacactttgcttaactaagtgtgacagtcaaatactggccactgtatcagttttggttgttagaagtggaaacttaaacccaattactggcacagtaagcagtgctcaagtttttctacgttttgatgcaaacggtgttcttttaacagaacactctacactaaaaaaatactggggctacaggcaaggagatagcatagatggcactccatacaccaatgctgttggtttcatgccaaattcaacagcttatccaaagacccaaagttctactactaaaaataatatagtgggacaagtatacatgaatggagatgtttcaaaacccatgcttcttactataactcttaatggtactgatgacaccaccagtgcatactcaatttcattttcatacacctggactaacggaagctatatcggagcaacatttggagctaactcatacaccttctcctacatagcccaagaataatcccacactgcatgccaacccacctttttcctttatctataaatggaaactgaaacaaaaataaagtttaagtgttttattgattcaacatttttttacaggattcgagtagttattttccctccaccctcccaactcatggaatacactatcctctccccacgcacagccttaaacatctgaatgccattggtaatggacatggttttggtctccacattccacacagtttcaaagcgagacaatctcgggtcggtcaaggagatgaaaccctccgggaactcctgcatctgcacctcacagtttaacagctgagggctgtcctcggtggttggaatcacagttatctggaataagagcgatgagaatcataatccgcgaacgggatcgggcggttgtggcgcattaggccccgcaacagtcgctgtctacgccgctccgtcaagctgctgctcaaggggtccgggtcctgggactccctgcgcatgatgccaatggccctaagcatcagtcgcctggtacggcgggcacagcagcggatgcgaatctcacttaggtcaaagcagtacgtacagcacagcaccaccacgttgttcaacagtccatagtttaacgtgctccagccaaaactcatctgtggaactatgctgcccacatgtccatcgtaccagattctgatgtaaatcaggtggcgccccctccagaacacactgcccatgtacatgatctccttgggcatgtgcaggtttactacctcccggtaccacatcacccgctggttaaacatgcagccctggataatcctgcggaaccagatggccagcactgccccgcccgccatgcagcgcaaagaccccgggtcctggcaatggcagtggatcacccaccgctcacggccgtggattaactgggaactaaacaagtctatgttggcacagcacaggcacacgctcatgcatgtcttcagcactctcaattccttgggggtcaggaccatatcccagggcacagggaactcttgcaggacagtaaagccggccgaacagggcaatcctcgcacggaacttacattgtgcatagacagggtatcgcaatcaggcagcaccggatgatcctccaccagagaagcgcggctctcggtctcctcacagcgaggtaaggtggccggcggttggtacggatgatggcaagataacgctaatcgtgttctggatcgtgtcatgatggagctgtttccggacattttcgtattttacgaagcagaacctggtccgggcactgcacaccgctcgtcggcgacggtctcggcgctttgagcgctcgatgttgaagttatagaacagccactcccttaaaacgtgcagtatctcctcagcctcttgggtgatgaaaatcccatttgccctaatggctctaatcacatcgaccacggtggaatgggccagacccagccagatgatgcaattttgttgggtttcgataacggcgggggagggaagaacaggaagaaccatgattaattttattccaaacggtctcggaacacttcaaaatgcaggtcccggaggtggcacctctcgcccccactgtgttggtggaaaataacagccaggtcaaaggtgacacggttctcgagatgttccacggtggcttccagcaaagcctccacgcgcacatccagaaacaagaggacagcaaaagcgggagcgttttctaattcctcaatcatcatattacactcctgcaccatccctagataattttcatttttccagccttgaatgattcgtattagttcctgaggtaaatccaagccagccatgataaaaagctcgcgcagagcgccctccaccggcattcttaagcacaccctcataattccaagagatcctgctcctggttcacctgtagcagattaacaagtggaatatcaattgctctgccgcaatccctaagctcctccctcagcagtaactgtatgtactcattcatatcttctcctaaatttttagccataggactgccaggaataagagaagggcaagccacattacagataaagcgaagtcctccccagtgagcattgccaaatgtaagattgaaataagcatgctggccagactcggtgatatcttccagataactggacagaaaatcaggcaagtaatttttaagaaaatcaacaaaagaaaagtcgtctaggtgcatgtttagagcctcaggaacaacgatggaataagtgcaaggagtgcgttccagcatggttagtgtttttggtgatctgtagaacaaaaaataaacatgcaatattaaaccatgctagcctggcgaacaggtggataaatcactttttccaacaccagacaggctacagggtctccggcgcgaccactgtagaagctgacattatgattaaaaagcatcaccgagagaccttcccggtggccggcatggataatttgagaagaagcatacactccgggaacattggcgtccgtgagtgaaaaaaagcggcctataaagcctcgaggcactacaatgcttaatcttaattccagcaaagcgaccccatgcggataaagcacaaaattggcaggtgcgtaaaaaatgtaattacttcccttctgctcaggcagcaaagcccccgctccctccagaaacacatacaaaacctcagcgtccatagcttaccgagcacggcaggcgcaacagtcaaagaaaaagctcagctctaacctaattgtccgcttttgtgctcaatatatagccctaacctacactgacgtaaaggccaaggtctaaaaatacccgccaacacgcccagaaaccggtgacacactaaaaaaatacgtacacttcctcaaacacccatactggcgttatttccgggttcccacgctacgtcacctttaaacgactttcaaattccgtcgaccgttaaacacatcagttatccgcccctaacagtcgccgctgttacgcccaattagcgcgcctattcccaaatttaataatggtgtttaaaccacacctggttttacgtcacatttaacacaataacttgcaacataactcctcccacataagttacgtcacctcccagcattaccccaccccttttagccatttactccacggccaatcaccacacagcgcgcacttttttaaatcacctcatttacatattggcaccattccatctataaggtatattattgatgatg

SEQ ID NO: 581 - DNA, 35935 bp, Ad5FS NHRC#7151 from Ft Jackson, SC 01/06/98
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgtccttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccttggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtgagcttagaaaacccttagggtattaggccaaaggcgcagctactgtggggtttatgaacaattcaagcaactctacgggctattctaattcaggtttctctagaatcggggttggggttattctctgtcttgtgattctctttattcttatactaacgcttctctgcctaaggctcgccgcctgctgtgtgcacatttgcatttattgtcagctttttaaacgctggggtcgccacccaagatgattaggtacataatcctaggtttactcacccttgcgtcagcccacggtaccacccaaaaggtggattttaaggagccagcctgtaatgttacattcgcagctgaagctaatgagtgcaccactcttataaaatgcaccacagaacatgaaaagctgcttattcgccacaaaaacaaaattggcaagtatgctgtttatgctatttggcagccaggtgacactacagagtataatgttacagttttccagggtaaaagtcataaaacttttatgtatacttttccattttatgaaatgtgcgacattaccatgtacatgagcaaacagtataagttgtggcccccacaaaattgtgtggaaaacactggcactttctgctgcactgctatgctaattacagtgctcgctttggtctgtaccctactctatattaaatacaaaagcagacgcagctttattgaggaaaagaaaatgccttaatttactaagttacaaagctaatgtcaccactaactgctttactcgctgcttgcaaaacaaattcaaaaagttagcattataattagaataggatttaaaccccccggtcatttcctgctcaataccattcccctgaacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccttgacaaaagaacccacactgattatgacacgcatactcggagctatgctaaccagcgtagccccgatgtaagctttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttcacagcggcagcctaacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtaacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 582 - DNA, 35306 bp, ATCC#AV-HAD7_AFIP, strain Gomen
ctatctatataatataccttatagatggaatggtgccaacatgtaaatgaggtaatttaaaaaagtgcgcgctgtgtggtgattggctgtggggtgaatgactaacatggggcggggcggccgtgggaaaatgacgtgacttatgtgggaggagttatgttgcaagttattgcggtaaatgtgacgtaaaaggaggtgtggtttgaacacggaagtagacagttttcccacgcttactgataggatatgaggtagttttgggcggatgcaagtgaaaattctccattttcgcgcgaaaactgaatgaggaagtgaatttctgagtcatttcgcggttatgacagggtggagtatttgccgagggccgagtagactttgaccgtttacgtggaggtttcgattaccgtgtttttcacctaaatttccgcgtacggtgtcaaagtcctgtgtttttacgtaggtgtcagctgatcgctagggtatttaaacctgacgagttccgtcaagaggccactcttgagtgccagcgagaagagttttctcctccgcgccgcaagtcagttctgcgctttgaaaatgagacacctgcgcttcctgccacaggagattatctccagtgagaccgggatcgaaatactggagtttgtggtaaataccctaatgggagacgacccggaaccgccagtgcagccttttgatccacctacgctgcacgatctgtatgatttagaggtagacgggccggaggatcccaatgagggagctgtgaatgggttttttactgattctatgctgctagctgccgatgaaggattggacataaaccctcctcctgagacccttgtcaccccaggggtggttgtggaaagcggcagaggtgggaaaaaattgcctgatctgggagcagctgaaatggacttgcgttgttatgaagagggttttcctccgagtgatgatgaagatggggaaactgagcagtccatccataccgcagtgaatgagggagtaaaagctgccagcgatgtttttaagttggactgtccggagctgcctggacatggctgtaagtcttgtgaatttcacaggaataacactgggatgaaagaactattgtgctcgctttgctatatgagaatgcactgccactttatttacagtaagtgtatttaagtgaaatttaaaggaatagtgtagctgtttaataactgttgaatggtagatttatgtttttacttgcgattttttgtaggtcctgtgtctgatgatgagtcaccttctcctgattcaactacctcacctcctgaaattcaggcgcccgcacctgcaaacgtatgcaagcccattcctgtaaagcctaagcctgggaaacgccctgctgtggataagcttgaggacttgttggagggtggggatggacctttggaccttagtacccggaaactgccaaggcaatgagtgccctgcagctgtgtttatttaatgtgacgtcatgtaataaaattatgtcagctgctgagtgttttattacttcttgggtggggtcttggatatataagtaggagcagatctgtgtggttagctcacagcaacttgctgccatccatggaggtttgggctatcttggaagacctcagacagactaggctactactagaaaacgcctcggacggagtctctggcctttggagattctggttcggtggtgatctagctaggctagtgtttaggataaaacaggactacagggaagaatttgaaaagttattggacgacattccaggactttttgaagctcttaacttgggccatcaggctcattttaaggagaaggttttatcagttttagatttttctactcctggtagaactgctgctgctgtagcttttcttacttttatattggataaatggatccgccaaactcacttcagcaagggatacgttttggatttcatagcagcagctttgtggagaacatggaaggctcgcaggatgaggacaatcttagattactggccagtgcagcctctgggagtagcagggatactgagacacccaccgaccatgccagcggttctgcaggaggagcagcaggaggacaatccgagagccggcctggaccctccggtggaggagtagctgacctgtttcctgaactgcgacgggtgcttactaggtctacgaccagtggacagaacaggggaattaagagggagaggaatcctagtgggaataattcaagaaccgagttggctttaagtttaatgagccgcaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacaatatagaattactaagaagattaatattagaaatgcatgctacatatcagggaatggggcagaggttataatagatacacaagataaagcagcttttagatgttgtatgatgggtatgtggccaggggttgtcggcatggaagcaataacacttatgaatattaggtttagaggggatgggtataatggcattgtatttatggctaacactaagctgattctacatggttgtagcttttttgggtttaataatacgtgtgtagaagcttgggggcaagttagtgtgaggggttgtagtttttatgcatgctggattgcaacatcaggtagggtgaagagtcagttgtctgtgaagaaatgcatgtttgagagatgtaatcttggcatactgaatgaaggtgaagcaagggtccgccactgcgcagctacagaaactgcctgcttcattctaataaagggaaatgccagtgtgaagcataatatgatctgtggacattcggatgagaggccttatcagatgctaacctgcgctggtggacattgcaatattcttgctaccgtgcatatcgtttcacatgcacgcaagaaatggcctgtatttgaacataatgtgattaccaagtgcaccatgcatataggtggtcgcaggggaatgtttatgccttaccagtgtaacatgaatcatgtgaaggtaatgttggaaccagatgccttttccagagtgagcgtaacaggaatctttgatatgaatattcaactatggaagatcctgagatatgatgacactaaaccaagggtgcgcgcatgcgaatgcggaggcaagcatgctagattccagccggtgtgcgtggatgtgactgaagacctgaggcccgatcatttggtgcttgcctgcactggagcggagttcggttctagtggtgaagaaactgactaaagtaagtagtgggggcaaaatgtggatggggactttcaggttggtaaggtggacaaattgggtaaattttgttaatttctgtcttgcagctgccatgagtggaagcgcttcttttgaggggggagtatttagcccttatctgacgggcaggctcccaccatgggcaggagttcgtcagaatgtcatgggatccactgtggatgggagacccgtccagcccgccaattcctcaacgctgacctatgccactttgagttcgtcaccattggatgcagctgcagccgccgccgctactgctgccgccaacaccatccttggaatgggctattacggaagcattgttgccaattccagttcctctaataatccttcaaccctggctgaggacaagctacttgttctcttggctcagctcgaggccttaacccaacgcttaggcgaactgtctaagcaggtggcccagttgcgtgagcaaactgagtctgctgttgccacagcaaagtctaaataaagatctcaaatcaataaataaagaaatacttgttataaaaacaaatgaatgtttatttgatttttcgcgcgcggtatgccctggaccatcggtttcgatcattgagaactcggtggatcttttccagtaccctgtaaaggtgggattgaatgtttagatacatgggcattagtccgtctcgggggtggagatagctccattgaagagcctcttgctccggggtagtgttataaatcacccagtcatagcaaggtcggagtgcatggtgttgcacaatatcttttaggagcagactaattgcaacggggaggcccttagtgtaggtgtttacaaatctgttgagctgggacgggtgcatccggggtgaaattatatgcattttggactggatcttgaggttggcaatgttgccgcctagatcccgtctcgggttcatattgtgcaggaccaccaagacagtgtatccggtgcacttgggaaatttatcatgcagcttagagggaaaagcatgaaaaaatttggagacgcctttgtgaccccccagattctccatgcactcatccataatgatagcgatggggccgtgggcagcggcacgggcgaacacgttccgggggtctgaaacatcatagttatgctcctgagtcaggtcatcataagccattttaataaactttgggcggagggtgccagattgggggatgaaagttccctgtggcccgggagcatagtttccctcacatatttgcatttcccaggctttcagttcagagggggggatcatgtccacctgcggggctataaaaaataccgtttctggagccggggtgattaactgggatgagagcaaattcctaagcagctgagacttgccgcacccggtgggaccgtaaatgaccccaattacgggttgcagatggtagtttagggagcgacagctgccgtcctcccggagcaggggggccacttcgttcatcatttcccttacatggatattttcccgcaccaagtccgttaggaggcgctctcccccaagtgatagaagctcctggagcgaggagaagtttttcagcggcttcagcccgtcagccatgggcattttggaaagagtctgttgcaagagctcgagccggtcccagagctcggtgatgtgctctatggcatctcgatccagcagacctcctcgtttcgcgggttgggacggctcctggagtagggaatcagacgatgggcgtccagcgctgccagggtccgatccttccatggtcgcagcgtccgagtcagggttgtttccgtcacggtgaaggggtgcgcgcctggttgggcgcttgcgagggtgcgcttcagactcatcctgctggtcgagaaccgctgccgatcggcgccctgcatgtcggccaggtagcagtttaccataagttcgtagttgagcgcctcggccgcgtggcctttggcacggagcttacctttggaagttttatggcaggcagggcagtagatacatttgagggcatacagcttgggcgcgaggaaaatggattcgggggagtatgcatccgcaccgcaggagacgcagacggtttcgcactccacaagccaggtcagatccggctcatcagggtcaaaaacaagttttccgccatgttttttgatgcgtttcttacctttggtttccatgagttcgtgtccacgctgggtgacaaagaggctgtccgtgtccccgtagaccgactttatgggcctgtcctcgagcggagtgcctcggtcctcttcgtagaggaatccagcccactctgatacaaaagcgcgtgtccaggccagcacaaaggaggccacgtgggaggggtagcggtcgttgtcaaccaggggatccaccttctctacggtatgtaaacacatgtccccctcctccacatccaagaatgtgattggcttgtaagtgtaggccacgtgaccaggggtccccgccgggggggtataaaagggggcggacctctgttcgtcctcactgtcttccggatcgctgtccaggagcgccagctgttggggtaggtattccctctcgaatgcgggcatgacctctgcactcaggttgtcagtttctaggaacgaggaggatttgatattgacagtaccagcagagatgccttttataagactctcgtccatctggtcagaaaacacaatcttcttgttgtccagcttggtggcaaatgatccatagagggcattggatagaagcttggcgatggagcgcatggtttggttcttttccttgtccgcgcgctccttggcggcgatgttaagctggacgtactcgcgcgccacacatttccattcaggaaagatggttgtcagttcatccggaactattctgactcgccatcccctattgtgcagggttatcagatccacactggtggccacctcgcctcggaggggctcattggtccagcagagtcgacctccttttcttgaacagaaaggggggagggggtctagcatgaactcatcaggggggtccgcatctatggtaaatattcccggtagcaaatctttgtcaaaatagctgatggtggcaggatcatccaaggtcatctgccattctcgaactgccagcgcgcgctcataggggttaagaggggtgccccagggcatggggtgggtgagcgcggaggcatacatgccacagatatcgtagacatagaggggctcttcgaggatgccgatgtaagtgggataacagcgcccccctctgatgcttgctcgcacatagtcatagagttcatgtgagggggcgagaagacccgggcccagattggtgcggttgggtttttccgccctgtaaacgatttggcgaaagatggcatgggaattggaagaaatagtaggtctctggaatatgttaaaatgggcatgaggtaggcctacagagtctcttatgaagtgggcatatgactcttgcagcttggctaccagctctgcggtgacgagtacatccagggcacagtagttgagagtttcctggatgatgtcataacgcggttggcttttcttttcccacagctcgcggttgagaaggtattcttcgtgatccttccagtactcttcgaggggaaacccgtctttttctgcacggtaagagcccaacatgtagaactgattgactgccttgtagggacagcatcccttctccactgggagagagtatgcttgggctgcattgcgcagcgaggtatgagtgagggcaaaagtgtccctgaccatgactttgaggaattgatacttgaagtcgatgtcatcacaggccccctgttcccagagttggaagtccgcccgcttcttgtaggcgggattgggcaaagcgaaagtaacatcattgaagaggatcttgccggccctgggcatgaaatttcgggtgattttaaaaggctgagggacctctgctcggttattgataacctgagcggccaagacgatctcatcaaagccattgatgttgtgccccactatgtacagttctaagaatcgaggggtgcccctgacatgaggcagcttcttgagttcttcaaaagtgagatctgtagggtcagtgagagcatagtgttcgagggcccattcgtgcatgtgagggttcgctttgaggaaggaggaccagaggtccactgccagtgctgtttgtaactggtcccggtactgacgaaaatgctgtccgactgccatcttttctggggtgatgcaatagaaggtttgggggtcctgccgccagcgatcccacttgagtttcatggcgatgtcataggcgatgttaacgagccgctggtctccagagagtttcatgaccagcatgaaggggattagctgcttgccaaaggaccccatccaggtgtaggtttccacatcgtaggtgaggaagagcctttctgtgcgaggatgagagccaatcgggaagaactggatttcctgccaccagttggaggaatggctgttgatgtgatggaagtagaactccctgcgacgcgccgagcattcatgcttgtgcttgtacagacggccgcagtactcgcagcgattcacgggatgcacctcatgaatgagttgtacctgacttcctttgacgagaaatttcagtggaaaattgaggcctggcgcttgtacctcgcgctctactatgttgtctgcatcggcatgaccatcttctgtctcgatggtggtcatgctgacgagccctcgcgggaggcaagtccagacctcggcgcggcaggggcggagctcgaggacgagagcgcgcaggccggagctgtccagggtcctgagacgctgcggagtcaggttagtaggcagtgtcaggagattgacttgcatgatcttttcgagggcgtgagggaggttcagatggtacttgatctccacgggtccgttggtggagatgtcgatggcttgcagggttccgtgccccttgggcgctaccaccgtgcccttgtttttccttttgggcggcggtggctctgttgcttcttgcatgtttagaagcggtgtcgagggcgcgcaccgggcggcaggggcggctcgggacccggcggcatggctggcagtggtacgtcggcaccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcgccagagttgtcctggtaggcgatctcggccatgaactgctcgatctcttcctcttgaagatctccgcggcccgctctctcgacggtggccgcgaggtcgttggagatgcgcccaatgagttgagagaaagcattcatgcccgcctcgttccagacgcggctgtagaccacagcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagcgcttccaagcgctccatggcctcgtagaagtccacggcaaagttgaaaaactgggagttacgcgcggacacggtcaactcctcttccagaagacggataagttcggcgatggtggtgcgcacctcgcgctcgaaagctcctaggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatagtctcggtgacggcacgaccgttctccctgggtctcagagtgaagacgcctccgcgcatctccctgaagtggtgactgggaggctctccgttgggcagggacaccgcgctgattatgcattttatcaattgccccgtaggtactccgcgcaaggacctgattgtctcaagatccacgggatctgaaaacctttcgacgaaagcgtctaaccagtcgcaatcgcaaggtaggctgagcactgtttcttgcgggcgggggcggctagacgctcggtcggggttctctctttcttctccttcctcctcttgcgagggtgagacgatgctgctggtgatgaaattaaaataggcagttttaagacggcggatggtggcgaggagcaccaggtctttgggtccggcttgttggatgcgcaggcgatgagccattccccaagcattatcctgacatctggccagatctttatagtagtcttgcatgagtcgttccacgggcacttcttcttcgcccgccctgccatgcatgcgagtgatcccgaacccgcgcatgggctggacaagtgccagatccgctacaaccctttcggcgaggatggcttgctgcacctgggtgagggtggcttgaaagtcgtcaaagtccacgaagcggtggtaggccccggtgttgattgtgtaggagcagttggccatgactgaccagttgactgtctggtgcccagggcgcacgagctcggtgtacttcaggcgcgagtatgcgcgcgtgtcaaagatgtaatcgttgcaggtgcgcaccaggtactggtagccgatgagaaagtgtggcgatggctggcggtacaggggccatcgctctgtagccggggctccgggggcgaggtcttccagcatgaggcggtggtagccgtagatgtacctggacatccaggtgataccggaggcggtggtggatgcacgtgggaactcgcgcacgcggttccagatgttgcgcagcggcatgaagtagttcatggtaggcacggtctggccagtgaggcgcgcgcagtcattgacgctctgtagacacggagaaaacgaaagcgatgagcggctcgactccgtggcctgggggaacgtgaacgggttgggtcgcggtgtaccccggttcgagtccaaagctaagcaatcacactcggatcggccggagccgcggctaacgtggtattggctatcccgtctcgacccagccgacgaatatccagggtacggagtagagtcgtttttgctgcttttttcctggacgtgtgccattgccacgtcaagctttacaacgctcagttctcgggccgtgagtggctcgcgcccgtagtctggagaatcagtcgccagggttgcgttgcggtatgcccccggttcgagcctaagcgcggctcgtatcggccggtttccgcgacaagcgagggtttggcagcccagtcatttccaagaccccgccagccgacttctccagtttacgggagcgagcccttttttttttttgtttttgtcgcccagatgcatccagtgctgcgacagatgcgcccccagcaacaggccccttctcagcaacagccacaaaaggctcttcttgctcctgcaactactgcagctgcagccgtgagcggcgcgggacagcccgcctatgatctggacttggaagagggcgagggattggcgcgcctgggggctccatcgcccgagcggcacccgcgggtgcaactaaaaaaggactctcgcgaggcatacgtgccccagcagaacctgtttagggacaggagcggcgaggagccagaggagatgcgagcatctcgatttaacgcgggtcgcgagctgcgccacggtctggatcgaagacgggtgctgcaagacgaggattttgaggtcgatgaagtcacagggatcagcccagctagggcacatgtggccgcggccaacctagtctcggcctacgagcagaccgtgaaggaggagcgcaacttccaaaaatcttttaacaaccatgtgcgcaccctgattgcccgcgaggaagtgaccctgggtctgatgcatctgtgggacctgatggaggctatcgcccaaaaccccactagcaaaccactgacagctcagctgtttctggtggttcaacatagcagggacaacgaggcattcagggaggcgttgttgaacatcaccgagcctgatgggagatggctgtatgatctgatcaacatcctgcaaagtattatagtgcaggaacgtagcctgggtttggctgagaaagtggcagctatcaactactcggtcttgagcctgggcaaatactacgctcgcaagatctacaagaccccctacgtacccatagacaaggaggtgaagatagatgggttttacatgcgcatgactctaaaggtactaactctaagcgacgatctgggggtgtatcgcaatgacaggatgcatcgcgcggtgagcgccagtaggaggcgcgagctgagcgacagagaacttatgcacagcttgcaaagagctctaacgggggccgggactgatggggagaactactttgacatgggagcggacttgcaatggcaacccagtcgcagggccatggaggctgcagggtgtgagcttccttacatagaagaggtggatgaagtcgaggacgaggagggcgagtacttggaagactgatggcgcgacccgtatttttgctagatggaacagcagcaggcaccggaccccgcaatgcgggcggcgctgcagagccagccgtccggcattaactcctcggacgattggacccaggccatgcaacgcataatggcgctgacgacccgcaaccccgaagcctttagacagcaaccccaggccaaccgcctttcggccatactggaggccgtagtgccctcccgctccaaccccacccacgagaaggtcctggctatcgtgaacgcgctggtggagaacaaggccatccgtcccgatgaggccgggctggtatacaatgctctcttggagcgcgtggcccgttacaacagcagcaacgtgcaaaccaacctggaccggatggtgaccgatgtgcgcgaggccgtgtctcagcgcgagcggttccagcgcgacgccaacttggggtcgttggtagcgctaaacgcttttctcagcacccagcccgccaacgtgccccgtggtcagcaagactatacaaactttttgagtgcattgagactcatggtagctgaggtgccccagagcgaggtgtaccagtccgggccagattacttcttccagaccagcagacagggcttgcagacagtgaacctgactcaggctttcaaaaacctgaagggtctctggggagtgcacgccccagtaggggatcgcgcgaccgtgtctagcttgctgactcccaactcccgcctgctgctgctgctggtatccccctttactgacagcggtagcatcgaccgcaactcctacttgggctacctgcttaacctgtatcgcgaggccataggacagagccaggtggacgaacagacctatcaagaaatcacccaagtgagccgcgccctgggtcaggaagacacgggcagtttggaagccaccctgaacttcttgttaaccaaccggtcgcagaagatccctcctcagtatgcgcttaccgctgaggaggagcggatccttagatacgtgcaacagagcgttggattgttcctgatgcaggagggggcgacacctaccgccgcgctggacatgacagctcgaaacatggagcccagcatgtatgctagtaacaggcctttcattaacaaactgctggactacctgcacagggcggccgccatgaactctgattatttcaccaatgctatcctgaacccacactggctgcccccacctggtttctacactggcgagtacgacatgcccgaccccaatgacgggttcctgtgggacgatgtagacagcagcatattctccccgcctcccggttatacagtttggaagaaggaagggggcgatacaaggcactcttccgtgtcgctgtccagaacggctggtgctgccgcgaccgtgcccgaagctgcaagtcctttccctagcttgcccttttcactaaacagcgttcgcagcagtgaacttgggagaataacccgcccgcgcttgatgggcgaggatgagtacttgaatgactctttgttgaggccagagagggaaaagaacttccccaacaatggaatagagagcctggtggataagatgagtagatggaagacctatgcgcaggatcacagagacgagcccaaaatcttgggggctacaagcagaccgacccgtagacgccagcgccacgacaggcagatgggtcttgtgtgggacgatgaggactctgccgatgatagcagcgtgttggacttgggtggaagaggagggggcaacccgttcgctcatctgcgtcccagattcgggcgcatgttgtaaaagtgaaagtaaaataaaaaggcaactcaccaaggccatggcgaccgagcgtgcgttcgttcttttttgttatctgtgtttagtacgatgaggagacgagccgtgctaggcggagcgatggtgtatccggagggtcctcctccttcttacgagagcgtgatgcagcaacaggcggcgatgatacagcccccactggaggctcccttcgtacccccgcggtacctggcgcctacggaagggagaaacagcattcgttactcggagctgtcgcccctgtacgataccaccaagttgtatctggtggacaacaagtcggcggacatcgcctccctgaactatcagaacgaccacagcaacttcctgaccacggtggtgcagaacaatgactttacccccacggaggctagcacccagaccatcaactttgacgagcggtcgcgatggggcggtcagctgaagaccatcatgcacaccaacatgcccaacgtgaacgagtacatgttcagcaacaagttcaaggcgagggtgatggtgtccagaaaggctcctgaaggtgttatagtaaatgacacctatgatcataaagaggatatcttaaagtatgagtggtttgagttcactttaccagaaggcaacttctcagccaccatgaccattgacctgatgaacaatgccatcattgacaactacctggaaattggcagacaaaatggagtgctggaaagtgacattggtgttaagtttgacactagaaactttaggctcgggtgggaccccgaaactaagttaattatgccaggagtctacacttatgaggcattccatcctgacattgttttgctgcctggctgcggggtagactttactgaaagccgacttagcaacttgcttggcatcaggaaaagacatccattccaggagggtttcaaaatcatgtatgaagatcttgaagggggtaatattcctgcccttttggatgtcactgcctatgaggaaagcaaaaaggataccactactgaaacaaccacactggctgttgcagaggaaactagtgaagatgataatataactagaggagatacctatataactgaaaaacaaaaacgtgaagctgcagctgctgaagttaaaaaagagttaaagatccaacctctagaaaaagacagcaagagtagaagctacaatgtcttggaagacaaaatcaacacggcctaccgcagctggtacctgtcctacaattacggtaaccctgagaaaggaataaggtcttggacactgcttaccacttcagatgtcacctgtggggcagagcaggtctactggtcgctccctgacatgatgcaagacccagtcaccttccgctccacaagacaagtcaacaactacccagtggtgggtgcagagcttatgcccgtcttctcaaagagtttctacaatgagcaagccgtgtactctcagcagctccgacaggccacttcgctcacgcacgtcttcaaccgcttccctgagaaccagatcctcatccgcccgccggcgcccacaattaccaccgtcagtgaaaacgttcctgctctcacagatcacgggaccctgccgttacgcagcagtatccggggagtccagcgcgtgaccgttactgacgccagacgccgcacctgtccctacgtttacaaggccctgggcatagtcgcgccgcgcgttctttcaagccgcactttttaaaaaacaaaaaatgtccattctcatctcgcccagtaataataccggttggggactgtatgcgcccaccaagatgtatggaggcgcccgcatacgctctacccagcaccctgtgcgcgttcgcggtcatttccgcgctccatggggcgcactcaagggtcgtacccgcactcggaccacggtcgatgatgtgatcgaccaggtggtcgccgatgctcgtaattatactcctactgcgcctacatctactgtggatgcagttattgacagtgtggtggcagacgcccgcgcctatgctcgccggaagagccgaaggaggcgcattgctaggcgccacagggctactaccgccatgcgagctgcaaaagctattctgcggagggccaaacgtgtggggcgaagagccatgcttagagcggccagacgcgcggcttcaggtgccagcagcggcaggtcccgcaggcgcgcggccacggcggcagcagcggccattgccaacatggcccaaccgcgaagaggcaatgtgtactgggtgcgtgatgccactaccggccagcgcgtgcccgtgcgcacccgcccccctcgcacttagaagatactgagcagtctccgatgttgtgtcccagcggcaagtatgtccaagcgcaaatacaaggaagagatgctccaggtcatcgcgcctgaaatctacggtccaccggtgaaggatgaaaaaaagccccgcaaaatcaagcgggtcaaaaataacaaaaaggaagaagatgacgctgatgggctggtggagtttgtgcgcgagttcgccccaagacggcgcgtgcagtggcgcgggcgcaaagtgcgtcaagtgctcagacccgggaccactgtggtctttacacctggcgagcgttccagcactacttttaaacggtcctatgatgaggtgtacggggatgacgatattcttgagcaggcggcagaccgccttgacgagtttgcttatggcaagcgcactagatccagtcccaaagaggaggcggtgtccattcccttggatcatggaaatcccacccccagcctcaaaccagtcaccctgcagcaagtgctgcccgtgcctgcgcggagaggcgtaaagcgcgagggtgaggacctatatcccaccatgcagctaatggtgcccaagcgccagaggctagaagacgtactggagaaaatgaaagtggatgccgatatccagcctgaggttaaagtaagacctattaaggaagtggcgccaggtttgggagtacaaaccttcgacatcaagattcccaccgagtccatggaagtgcagaccgaacctgcaaaacccacaaccacctcaattgaggtgcaaacggaaccctggatgcccgcgcccgttgccgcccccagcaccactcgaagatcacgacgaaagtacggcccagcaagtctgctaatgcccaactatgctctgcacccatccatcattcccactccgggttacagaggcactcgctactatcgaaaccggagcaacacctctcgccgccgcaaaccacctgcaagtcgcactcgccgtcgccgccgccgcaacactgccagcaaattgactcccgccgccctggtgcggagagtgtaccgcgatggtcgcgctgaacctctgacgctgccgcgcgcgcgctaccatccaagcatcaccacttaatgactgttgacgctgcctccttgcagatatggccctcacttgccgccttcgcgtccccattactggctaccgaggaagaaactcgcgccgtagaaggatgttggggcgagggatgcgccgccacagacgaaggcgcgctatcagcagacgattagatggtggctttttgccagctcttatacccatcatcgccgcagcgatcggggcgataccaggcatagcttccgtggcggttcaggcctcgcagcgccactaacattggaaaaacttataaataaaaaatagaatggactctgacgctcctggtcctgtgactatgtttttgtagagatggaagacatcaatttttcatccctggctccgcgacacggcacgaggccgtacatgggcacctggagcgacatcggcacgagccaactgaacgggggcgccttcaattggagcagtatctggagcgggcttaaaaattttggctcgaccgtaaaaacctatgggaacaaagcttggaacagcagcacagggcaggctctgagaaataagcttaaggaacaaaacttccaacagaaggtggtcgatgggatcgcctctggtattaacggcgtagtggatctggccaaccaggctgtacaaaaacagataaacagccgactggacccgccgcccgcaacccctggtgaaatggaagtggaggaagagcttcctccgctggaaaagcggggcgacaagcgtccgcgacccgagctggagcagacgctggtgacgcgcgcagacgagcccccttcatacgaggaggcagtaaagctaggaatgcccactactaggcccgtagctcacatggctaccggggtgatgaaaccttctcagtcacatcgacccgccaccttggacttgcctcctccccctgcttctgcggcgcttgttcccaaacctgtcgctaccagaaagcccaccgccgtacagcccgtcgccgtagccagaccgcgtcctgggggcacaccgcgcccgaaagcaaactggcaaagtactctgaacagcatcgtgggtctgggcgtgcagagtgtaaagcgccgtcgctgctattaattaaatatggagtagcgcttaacttgcttgtctgtgtgtatgtatcatcaccacgccgccgcagcagaggagaaaggaagaggtcgcgcgccgaggctgagttgctttcaagatggccaccccatcgatgatgccccaatgggcatacatgcacatcgccggacaggatgcttcggagtacctgagtccgggtctggtgcagttcgcccgtgcaacagacacctacttcagtatggggaacaaatttagaaaccccacagtggcgcccacccacgatgtgaccaccgaccgtagccagcgactgatgctgcgcttcgtacccgttgaccgggaagacaatacctactcttacaaagttcgctacacgctggctgtaggcgacaacagagtgcttgacatggccagcacattctttgacattcggggggtgcttgatagaggtcctagctttaagccatattctggcacagcttacaattcactggctcctaagggcgcgcccaatacatctcagtggatagttacagcaggagaagaaagagcagtaactaccaccacaaacacatttggcattgcttccatgaagggagacaatattactaaagaaggtttagaaattgggaaagacattactgcagacaacaagcccatttatgccgataaaacatatcagccagagcctcaagttggagaagaatcatggactgatactgatggaacaaatgaaaagtttggaggtagagctcttaaaccagctaccaaaatgaagccatgctacgggtcttttgcaagacctacaaatataaaagggggccaagctaaaaacagaaaagtaaaaccaaccgaaggagatgttgagactgaggagccagatattgatatggaattttttgatggtagagaagctgctgacgctttttcgcctgaaattgtgctttacacggaaaatgtcaatttagaaactccagacagccatgtagtttacaagccaggaacttctgatgataactctcatgcaaatttgggtcaacaagccatgcctaacagacccaattacattggcttcagggataactttgtaggcctaatgtactacaacagtactggaaatatgggagttttggctggccaagcatcacaactgaatgcagtggttgacttgcaggacagaaacactgaactgtcatatcagcttttgcttgattctctgggagacagaaccagatacttcagtatgtggaaccaggctgtggacagttatgatcccgatgttcgcattattgaaaatcacggcatcgaggatgaactgcctaattactgttttcctctggatggcataggaccagcgaaaacatatcaaggcattaaatctaaagacaatggatgggaaaaagatgataatgtttctaaatctaatgaaatagccataggcaacaaccaggctatggaaattaatatccaagctaacctttggagaagttttctgtactccaatgtggctttgtaccttccagatgtttacaagtacacgccaactaacattactctgcccgccaacaccaacacctatgagtacatgaacgggcgagtggtatccccatctctggttgattcatacatcaacattggcgccaggtggtctcttgacccaatggacaatgtgaatccattcaaccaccaccgcaatgctggtctgcgctaccggtccatgcttctgggcaatggtcgttatgtgcctttccacatacaagtgcctcaaaaattctttgctgtcaagaacctacttcttctacctggctcctacacctatgagtggaacttcagaaaggatgtgaacatggtcctgcaaagttcccttggaaatgacctcagaacagatggtgctaccataagtttcaccagcatcaatctgtatgccaccttcttccccatggctcacaacacagcttccacccttgaagccatgctgcgcaacgataccaatgatcagtcattcaacgactacctctctgcagctaacatgctttaccccatccctgccaatgcaaccaacattccaatttccatcccatctcgcaactgggcagccttcaggggctggtccttcactaggctcaaaaccaaggagactccatctcttggatcagggttcgatccctacttcgtatattctggatctattccctacctggatggcaccttttaccttaaccacactttcaagaaggtctccatcatgtttgactcctcagtcagctggcctggcaatgacaggctgttgagcccaaatgagtttgaaatcaagcgcactgtggacggggaagggtacaatgtggcccaatgtaacatgaccaaagactggttcctggttcagatgcttgccaactacaacattggctaccagggcttttacatccctgagggatacaaggatcgcatgtactcctttttcagaaacttccagcctatgagcaggcaggtggttgatgaggttaattacactgactacaaagccgtcaccttaccataccaacacaacaactctggctttgtagggtatcttgcacctactatgagacaaggggaaccttacccagccaattatccatacccgctcatcggaactactgccgttaagagtgtcacccagaaaaagttcctgtgtgacaggaccatgtggcgcattcccttctccagcaacttcatgtccatgggggcccttaccgacctgggacagaacatgctctatgccaactcagcccatgcgctggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataagaagcctcttgcttcttgcaagcagcagctgcagccatgacatgcgggtccggaaacggctccagcgagcaagagctcaaagccatcgtccgagacctgggctgcggaccctatttcctgggaacctttgacaagcgtttcccggggttcatggcccccgacaagctcgcctgtgccatagtcaacactgccggacgcgagacggggggagagcactggctggcttttggttggaacccgcgctccaacacctgctacctttttgatccttttgggttctcggatgagcggctcaaacagatttaccagtttgagtacgaggggctcctgcgccgcagtgcccttgctaccaaaaaccgctgcatcaccctggagaagtccacccaaagcgtgcagggtccgcgctcagccgcctgtggacttttttgctgtatgttccttcatgcctttgtgcactggcccgaccgccccatggacggaaaccccaccatgaagttgctgactggggtgtccaacagcatgctccaatcaccccaagtccagcccaccctgcgccgcaaccaggaggcgctatatcgcttcctaaacacccactcatcttactttcgttctcaccgcgcgcgcatcgaaagggccaccgcgtttgaccgtatgaatatgcaataagtcatgtaaaaccgtgttcaataaacagcactttatttttacatgcactgaggctctggtttttgctcattcgtctcatcattcactcagaagtcaaatggattctggcgggagtcatagtgacccgcgggcagggatacgttgcggaactgtaacctgttctgccacttgaactcgggtatcaccagcttgggaactggaatctcgggaaaggtgtcttgccacaactttctggtcagttgcagggcgccaagcaggtcaggagcagagatcttgaaatcacagttggggccggcattttggacacgggagtttcggtacactgggttgcaacactggaacaccatcaaggctgggtgtctcacgcttgccagcacggtcgggtcactgatggtagccacatccaagtcttcagcattggccatcccaaagggggtcatcttacaggtctgcctgcccatcacgggagcacagcctggcttgtggttgcaatcgcaatgaatggggatcagcatcatcctggcttggtcgggggttatccctgggtacacggccttcatgaaggcttcgtactgcttgaaagcttcctgagccttaattccctcggtgtagaacatcccacaggacttgctggaaaattggttagtagcacagttggcatcattcacacagcagcgggcatcgttgttggccaactggaccacatttctgccccagcggttctgggtgatcttggctctgtctgggttctccttcatagcgcgctgcccgttctcgctcgccacatccatctcgataatgtggtccttctggatcatgatagtgccatgcaggcatttcaccttgccttcgtaatcggtgcatccatgagcccacagagcgcacccggtgcactcccaattattgtgggcgatctcagaataagaatgcaccaatccctgcatgaatcttcccatcatcgctgtcagggtcttcatgctactaaatgtcagcgggatgccgcggtgctcctcgttcacatactggtggcagatacgcttgtactgctcgtgctgctctggcatcagcttgaaagaggttctcaggtcattatccagcctgtacctctccattagcacagccatcacttccatgcccttctcccaggcagataccaggggcaagctcaaaggattcctaacagcaatagaagtagctcctttagatataggatcattattgtcgatcttctcaacactcctcttgccatccttctcaatgatgcgcaccggggggtagctgaagcccacggccaccaactgaacctgttctctttcttcttcgctgtcctggctgatgtcttgcagagggacatgcttggtcttcctgggcttcttcttgggagggattgggggaggactgttgctccgttccggagacagggatgaccgcgaagtttcgcttaccagtaccacctggctctcgatagaagaattggaccccacgcgacggtaggtgttcctcttcgggggcagaggtggaggtgactgagatgggctgcggtctggccttggaggcggatggctggcagagcccattccgcgttcgggggtgtgctcccgttggcggtcgcttgactgatttcctccgcggctggccattgtgttctcctaggcagagaaacaacagacatggaaactcagccatcactgccaacatcgctgcaagcgccatcacacctcgcccccagcagcgacgaggaggaaagcttaaccaccccaccacccagtcccgctaccaccacctctaccctcgatgatgaggaggaggtcgacgcagcccaggagatgcaggcgcaggataatgtgaaagcggaagagattgaggcagatgtcgagcaggacccgggctatgtgacaccggcggagcacgaggaggagctgaaacgttttctagacagagaggatgacgaccgcccagagcatcaagcagatggcgatcaccaggaggctggcatcggggatcatgttgccgactacctcaccgggcttgggggggaggacgtgctcctcaaacatctagcaaggcagtcgaacatagttaaagacgcactactcgacctcaccgaagtgcccatcagtgtggaagagcttagccgcgcctacgagctgaacctcttttcgcctcagataccccccaagcggcagccaaacggcacctgcgaggccaaccctcgactgaacttctatccggcttttactgtccccgaagtgctggccacctaccacatcttttttaagaaccaaaagattccagtctcctgccgcgccaaccgcacccgcgccgatgcccttctcaacttgggtccgggagctcgcttacctgatatagcttccttggaagaggttccaaaaatctttgagggtctgggaagtgatgagactcgggccgcaaatgctctgcaacagggagagaatggcatggataaacatcacagcgctctagtggaactggagggtgacaatgcccggcttgcagtgctcaagcgcagtatcgtggtcacccattttgcctaccccgctgttaacctgccacccaaagtcatgagcgctgtcatggaccatctgctcatcaaacgagcaagtccactttcagaaaaccagaacatgcaggatccagacgcctcggacgatggcaagccggtagtcagtgacgagcagctatctcgctggctgggtaccaactccccccgagatttggaagaaaggcgcaagcttatgatggctgtagtgctagtaactgttgagctggagtgtctgcgccgcttttttaccgaccccgagaccctgcgcaaactagaggagaacctgcactacaccttcagacatggcttcgtgcgccaggcatgcaagatttccaacgtggagctcaccaacctggtttcatacatgggcattttgcatgagaaccggctagggcagagcgttctgcacaccaccctgaagggggaggcccgccgcgactacatccgagactgtgtctacctctacctctgccatacctggcagactggtatgggtgtgtggcaacagtgtttggaagagcagaacctcaaagaactggacaagctcttgcagagatcccttaaagccctgtggacaggttttgacgagcgcaccgtcgcctcggacctggcggacatcatcttccccgagcgtcttagggttactctgcgaaacggcctgccagacttcatgagccagagcatgcttaacaactttcgctctttcatcctggaacgctccggtatcctgcctgtcacctgttgtgcgctgccctccgactttgtgcctcttacctaccgcgaatgcccaccgccgctatggagccactgctacctgttccgcctggccaactacctctcctaccactcggatgtgatagaggatgtgagcggagacggcctgctggaatgccactgccgatgcaatttatgcacaccccaccgctccctcgtctgcaacccacagttgctaagcgagacccagatcatcggcaccttcgagttgcagggtcccaacagtgaaggcgaggggtcttctccgggtcatagtctgaaactgacaccggggctgtggacctccgcctacctgcgcaagtttcatcccgaggactaccacccctatgagatcaggttctatgaggaccagacacatcctcccaaagtcgagctctcagcctgcgtcattacccagggagcaattctggcccaattgcaagccatccaaaaatcccgccaagaatttctgctaaaaaagggaagcggggtctaccttgacccccagaccggtgaggagctcaacacaagattcccccaggatgtcccatcgccgaggaagcaagaagctgaaggtgcagctgtcgcccccagaggatatgaaggaacactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggagcccagcggcggcccaacagtagatgggacgagaccgggcgattcccaaacccaaccaccgcttccaagaccggtaagaaggagcgacagggatacaaatcctggcgtggacataaaaacgctatcatctcctgcttgcatgaatgcgggggcaacatatcctttacccggcgatacctgctcttccaccacggtgtgaacttcccccgcaatatcttgcattactaccgtcacctccacagcccctactgcagtcagcaagtcccgacaaccccgacagaaaaagacagcagcgacaacggtgaccagaaaaccagcagttagaaaatccacaacaagtgcagcaggaggaggactgaggatcacagcgaacgagccagcgcagaccagagagctgaggaaccggatctttccaaccctctatgccatcttccagcagagtcgggggcaagagcaggaactgaaagtaaaaaaccgatctctgcgctcgctcaccagaagttgtttgtatcacaagagcgaagaccaacttcagcgcactctcgaggacgccgaggctctcttcaacaagtactgcgcgctgactcttaaagagtagcccttgcccgcgcttattcgaaaacggcgggaatcacgtcacccttggcacctgtcctttgccctcgtcatgagtaaagagattcccacgccttacatgtggagctatcagccccaaatggggttggcagcaggcgcctcccaggactactccacccgcatgaattggcttagcgccgggccctcaatgatatcacgggttaatgatatacgagcttatcgaaaccagttactcctagaacagtcagctctcaccaccacaccccgccaacaccttaatccccgaaattggcccgccgccctggtgtatcaggaaactcccgctcccaccaccgtactacttcctcgagacgcccaggccgaagttcatatgactaacgcaggtgtacagctggcgggcggttccgccctatgtcgtcaccgacctcaacagagtataaaacgcctggtgatcagaggccgaggtatccagctcaacgacgagtcggttagctcttcgcttggtctgcgaccagacggagtcttccaaatcgccggctgtggaagatcttccttcacccctcgtcaggctgtactgactttggagagttcgtcctcgcagccccgctcgggcggcatcggaactctccagtttgtggaggagtttactccctctgtctacttcaaccccttctccggctctcctggccagtacccggacgagttcataccgaacttcgacgcaatcagcgagtcagtggatggctatgattgatgtctaatggtggcgcggctgagctagctcgactgcgacacctagaccactgccgccgctttcgctgcttcgcccgggaactcaccgagttcatctacttcgaactccccgaggagcaccctcagggtccggcccacggagtgcggattaccatcgaagggggaatagactctcgcctgcatcgaatattctcccagcgacccgtgctgattgagcgcgaccagggaaatacaaccatctccatctactgcatctgtaaccaccccggattgcatgaaagcctttgctgtcttgtttgtgctgagtttaataaaaactgagttaagaccctcctacggactaccgcttcttcaatcaggactttacaacaccaaccagatcttccagaagacccagacccttcctcctctgatccaggactctaactctaccttaccagcaccatccactactaaccttcccgaaactaacaagcttggatctcatctgcaacaccgcctttcacgaagccttctttctgccaatactaccactcccaaaaccggaggtgagctccgcggtctccctactgacgacccctgggtggtagcgggttttgtaacgttaggagtagttgcgggtgggcttgtgttaatcctttgctacctatacacaccttgctgtgcatatttagtcatattgcgctgttggtttaaaaaatgggggccatattagtcgtgcttgctttactttcgcttttgggtctgggctctgctaatctcaatcctcttgatcacgatccatgtctagacttcgacccagaaaactgcacacttacttttgcacccgacacaagccgtctctgtggagttcttattaagtgcggatgggactgcaggtccgttgaaattacacataataacaaaacatggaacaataccttatccaccacatgggagccaggagttcccgagtggtatactgtctctgtccgaggtcctgacggttccatccgcattagtaacaacacttttattttttctgaaatgtgcgatctggccatgttcatgagcagacagtatgacctatggcctcccagcaaagagaacattgtggcattttctattgcttattgcttggtaacatgcattatcactgctatcatttgtgtgtgcatacacttgcttatagttattcgccctagacaaagcaataaggaaaaagagaaaatgccttaacctttttactcataccttttctttacagcatggctactgttacagctctaattattgccagcattgtcactgtcgctcacgggcaaacaattgtccatattaccttaggacataatcacacccttgtagggcccccaattacttcagaggttatttggaccaaacttggaagtgttgattattttgatataatttgcaacaaaactaaaccaatatttgtaatctgtaacagacaaaatctcacgttaattaatgttagcaaaatttataacggttactattatggttatgacagatccagtagtcaatataaaaattacttagttcgcataactcagcccaaatcaacagtgccaactatgacaataattaaaatggctaataaagcattagaaaattttacatcaccaacaacgcccaatgaaaaaaacattccaaattcaatgattgcaattattgcggcggtggcattgggaatggcactaataataatatgcatgttcctatatgcttgttgctataaaaagtttcaacataaacaggatccactactaaattttaacatttaattttttatacagatgatttccactacaatttttatcattactagccttgcggctgtaacttatggccgttcacacctaactgtacctgttggctcaacatgtacactacaaggaccccaacaaggctatgtcacttggtggagaatatatgataatggagggttcgctagaccatgtgatcagcctggtacaaaattttcatgcaacggaagagacttaaccataattaacataacatcaaatgagcaaggcttctattatggaaccaactataaagatagtttagattacaacattattgtagtgccagccaccacttctgctccccgcaaaaccactttctctagcagcagtgccaaagcaagcacaattcctaaaacagcttctgctatgttaaagcttcaaaaaatcgctttaagtaattccacagccgctcccaaaacaattcctaaatcaacaattggcatcattactgccgtggtagtgggattaattattatatttttgtgcataatgtactatgcctgctgctatagaaaacatgaacaaaaaggtgatgcattactaaattttgacatttaattttttatagaattatgatattgtttcaatcaaataccactaacactatcaatgtgcagactactttaaatcatgacatggaaaaccacactacctcctatgcatacataaacattcagcctaaatacgctatgcatctaaaaatcaccatactaattgtaattggaattcttatactatctgttattctttattttctattctcctatgattagtcgtccccatatagctctgaatgaaatctaagatcttttttttttctcttacagtatggtgaacaccaatcatgatccctagaaatttcttcttcaccatactcatctgtgctttcaatgtctgtgctactttcacagcagtagccactgcaagcccagactgtataggaccatttgcttcctatgcactttttgccttcgttacttgcatctgcgtgtgtagcatagtctgcctggttattaattttttccaactggtagactggatctttgtacgaattgcctacctacgtcaccatcccgaataccgcaatcaaaatgttgcggcacttcttaggcttatttaaaaccatgcaggctatgctaccagtcattttaattctgctactaccctgcattgccctagcttccaccgccactcgcgctacacctgaacaacttagaaaatgcaaatttcaacaaccatggtcatttcttgattgctaccatgaaaaatctgatttccccacatactggatagtgattgttggaataattaacatactttcatgtacatttttctcaatcacaatataccccacatttaattttgggtggaattctcccaatgcactgggttacccacaagaaccagatgaacatattccactacaacacatacaacaaccactagcactggtagagtatgaaaatgagccacaaccttcactgcctcctgccattagttacttcaacctaaccggcggagatgactgaaatactcaccacctccaattccgccgaggatctgcttgatatggacggccgcgtctcagaacagcgactcgcccaactacgcatccgccagcagcaggaacgcgtgaccaaagagctcagagatgtcatccaaattcaccaatgcaaaaaaggcatattttgcttggtaaaacaagccaaaatatcctacgagatcaccgctactgaccatcgcctctcttacgaacttggcccccaacgacaaaaatttacatgcatggtgggaatcaaccctatagttatcactcagcaaagtggagatactaaggggtgcattcactgctcttgtgattccatcgagtgcacctacaccctgctaaagaccctatgcggcttaagagacctgctacccatgaattaaaaattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttaactcctctcctgtacccacaatcttcatgtctttcttcccagatgaccaagagagtccggctcagtgattccttcaaccctgtctacccctatgaagatgaaagcacctcccaacacccctttataaacccagggtttatttccccaaatggctttacacaaagcccagacggagttcttactttaaaatgtttaaccccactaacaaccacaggcgggtctctacagttaaaagtgggagggggtcttacaatagatgacaccgacggttttttgaaagaaaacataagtgccgccacaccactcgttaagactggtcactctataggtttgtcgctaggacccggattaggaacaaatgaaaacaaactttgtgccaaattgggagaaggacttacattcaattccaacaacatttgcattgatgacaatattaacaccctatggacaggagttaaccccaccacagccaactgtcaaataatggcctccagtgaatctaatgattgcaaattaattctaacactagttaaaactggagcccttgtcactgcatttgtttatgttataggagtatctaacgattttaatatgctaactacacataaaaatataaatttcactgcagagctgttttttgattctactggtaatttactaactagcctttcatccctaaaaactccacttaatcataaatcagggcaaaacatggctactggtgcccttactaatgctaaaggtttcatgcccagcacaactgcctatcctttcaatgttaattccagagaaaaagaaaactacatttacggaacttgttactacacagctagtgatcacactgcttttcccattgacatatctgtcatgcttaaccaaagagcattaaataatgagacatcatattgtattcgtgtaacttggtcctggaacacaggagttgccccagaagtgcaaacctctgctactaccctagtcacctctccatttaccttttactacattagagaagacgactgacaaaataaagtttaacttgtttatttaaaatcaattcataaaattcgagtagttattttgcctcccccttcccatttaacagaatacaccaatctctccccacgcacagctttaaacatttggataccattacagatagacatagttttagattccacattccaaacagtttcaaagcgagccaatctggggtcagtgatacataaaaatgcatcgggatagtcttttaaagcgctttcacagtccaactgctgcggatgcgactccggggtctggatcacggtcatctggaagaagaacgatgggaatcataatccgaaaacggaatcgggcgattgtgtctcatcaaacccacaagcagccgctgtctgcgtcgctccgtgcgactgctgcttataggatcgggatccacagtgtcctgaagcatgattttaatagcccttaacattaactttctggtgcggtgcgcgcagcaacgcattctgatttcacttagattactacagtaggtacagcacattatcacaatattgtttaataaaccataattaaaagcgctccagccaaaactcatatcagatataatcgcccctgcatgaccatcataccaaattttaatataaattaaatgtcgttccctcaaaaacacactacccacatacataatctcttttggcatgtgcatattaacaatctgtctgtaccatggacaacgttggttaatcatgcaacccaatataaccttccgaaaccacactgccaacaccgctcccccagccatgcattgaagtgaaccctgccgattacaatgacaatgaagaacccaattttctcgaccatgaatcacttgagaatgaaaaatatctatagtagcacaacaaagacataaatgcatgcatcttctcataattcttaactcctcgggatttagaaacatatcccaaggaatgggaaactcttgcagaacagtaaagctggcagaacaaggaagaccacgaacacaacttacactatgcatagtcatagtatcacaatctggcaacagcgggtggtcttcagtcatagaagctcgggtttcattttcctcacatcgtggtaactgggctctggtgtaagggtgatgtctggcgcaagatgtcgagcgcgcgcgcaaccttgtcataatggagttgcttcctgacattctcgtattttgtatagcaaaacgcggccctggcacaacacactcttcttcgtcttctatcctgccgcttagtgtgttccgtctgataattcaagtacagccacactcttaagttggtcaaaagaatgctggcttcagttgtaatcaaaactccatcatatttaattgttctaaggaaatcatccacggtagcatatgcaaatcccaaccaagcaatgcaactggattgcgtttcaagcagcacaggagagggaagagacggaagaatcatgttaatttttattccaaacgatctcgcagtacttcaaattgtagatcgcgcagatggcatctatcgcccccactgtgttggtgaaaaagcacagctaaatcaaaagaaatgcgattttcaaggtgctcaacggtggcttccaacaaagcctccacgcgcacatccaaaaacaaaagaataccaaaagaaggagcattttctaactcctcaaacatcatattacattcttgcaccattcccagataattttcagctttccaaccttgaattattcgtgtcagttcttgtggtaaatccaaaccacacattacaaacaggtcccgaagggcgccctccaccaccattcttaaacacaccctcataatgacaaaatatcttgctcctgtgtcacctgtagcaaattaagaatggcatcatcaattgatatgcccttggctctaagttcttctctaagttctagttgtaaatactctctcatattatcaccaaactgcttagccagaagccccccgggaacaatagcaggggacgctacagtgcagtacaagcgcagacctccccaattggctccagcaaaaacaagattagaataagcatactgggaaccaccagtaatatcatcaaagttgctggaaatataatcaggcagagtttcttgtaaaaattgaataaaagaaaaattttccaaaaaaacattcaaaacctctgggatgcaaatgcaataggttaccgcgctgcgctccaacattgttagttttgaattagtctgtaaaataaaagaaacaaacgtcatatcatagtagcctgtcgaacaggtggataaatcagtctttccatcacaagacaagccacagggtctccagctcgaccctcgtaaaacctgtcatcgtgattaaacaacagcaccgaaagttcctcgcggtggccagcatgaataattcttgatgaagcatataatccagacatgttagcatcagttaaagagaaaaaacagccaacatagcctctgggtataattatgcttaattttaagtttagcaaagccacccctcgcggatacaaagtaaaaggcacaggagaataaaaaatataattatttctctgctgctgttcaggcaacatcgcccctggtccctctaaatacacatacaaagcctcatcagccatggcttaccagacaaagtatagcgggcgcacaaagcacaagctctaaagaagctctaaagacgctctccaagctctccacaatatatacacaagccctaaactgacgtaatgggagtaaagtgtaaaaaatcccgccaagcccaacacacaccccgaaactgcgtcagcagggaaaagtacagtttcacttccgcaaacccaacacgcgtaacttcctctttctcacggtacgtcacatccgattaacttgcaacgtcattttcccacggccgccccgcccatgttagtcattcaccccacagccaatcaccacacagcgcgcacttttttaaattacctcatttacatgttggcaccattccatctataaggtatattatatagatag

SEQ ID NO: 583 - DNA, 35198 bp, Ad7FS NHRC#1315 from NTC Great Lakes, IL 11/19/97
catcatcaataatataccttatagatggaatggtgccaatatgtaaatgagggaatttaaaaaagtgcgcgctgtgtggtgattggctgtggggtgaacggctaaaatgggcggggcggccgtgggaaaatgacgtgacttatgtgggaggagctatgttgcaagttattgcggtaaatgtgacgtaaaacgaggtgtggtttgaacacggaagtagacagttttcccacgcttactgacaggatatgaggtagttttgggcggatgcaagtaaaaattctccatttttgcgcgaaaactgaatgaggaagtgaatttctgagtcatttcgcggttatgacagggtggagtatttgccgagggccgagtagactttgaccgtttacgtggaggtttcgattaccgtgtttttcacctaaatttccgcgtacggtgtcaaagtcctgtgtttttacgtaggtgtcagctgatcgctagggtatttaaacctgacgagttccgtcaagaggccactcttgagtgccagcgagaagagttttctcctccgcgccgcaagtcagttctgcgctttgaaaatgagacacctgcgtttcctgccacaggagattatctccagtgagaccgggatcgaaatactggagtttgtggtaaataccctaatgggagacgacccggaaccgccagtgcagcctttcgatccacctacgctgcacgatctgtatgatttagaggtagacgggcctgaggatcccaatgaggaagctgtgaatgggttttttactgattctatgctgctagctgccgatgaaggattggacataaaccctcctcctgagacccttgttaccccaggggtggttgtggaaagcggcagaggtgggaaaaaattgcctgatctgggagcagctgaaatggacttgcgttgttatgaagagggttttcctccgagtgatgatgaagatggggaaactgagcagtccatccataccgcagtgaatgagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccactttatttacagtaagtgtatttaagtgaaatttaaaggaatagtgtagctgtttaataactgttgaatggtagatttatgttttttacttgtgattttttgtaggtcctgtgtctgatgatgagtcaccttctcctgattcaactacctcacctcctgaaattcaggcgcccgcacctgcaaacgtatgcaagcccattcctgtaaagcctaagcctgggaaacgccctgctgtggataagcttgaggacttgttggagggtggggatggacctttggaccttagtacccggaaactgccaaggcaataagtgccctgcagctgtgtttatttaatgtgacgtcatgtaataaaattatgtcagctgctgagtgttttattacttcttgggtggggacttggatatataagtaggagcagatctgtgtggttagctcacagcaacctgctgccatccatggaggtttgggctatcttggaagacctcagacagactaggctactgctagaaaacgcctcggacggagtctctggcctttggagattctggttcggtggtgatctagctaggctagtgtttaggataaaacaggactacagcgtagaatttgaaaagttattggacgacagtccaggactttttgaagctcttaacttgggtcatcaggctcattttaaggagaaggttttatcagttttagatttttctactcctggtagaactgctgctgctgtagcttttcttacttttatattggataaatggatccgccaaactcacttcagcaagggatacgttttggatttcatagcagcagctttgtggagaacatggaaggctcgcaggatgaggacaatcttagattactggccagtgcagcctctaggagtagcagggatactgagacacccaccgaccatgccagcggttctgcaggaggagcagcaggaggacaatccgagagccggcctggaccctccggtggaggagtagctgacctgtttcctgaactgcgacgggtgcttactaggtctacgaccagtggacagaacagaggcattaagagggagaggaatcctagtgggaataattcaagaaccgagttggctttaagtttaatgagccgcaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacaatatagaattactaagaagattaatattagaaatgcatgctacatatcagggaatggggcagaggttataatagatacacaagataaagcagcttttagatgttgtatgatgggtatgtggccaggggttgtcggcatggaagcagtaacacttatgaatattaggtttagaggggatgggtataatggcattgtatttatggctaacactaagctgattctacatggttgtagcttttttgggtttaataatacgtgtgtagaagcttgggggcaagttagtgtgaggggttgtagtttttatgcatgctggattgcaacatcaggtagggtcaagagtcagttgtctgtgaagaaatgcatgtttgagagatgtaatcttggcatactgaatgaaggtgaagcaaggatccgccactgcgcagctacagaaactggctgcttcattctaataaagggaaatgccagtgtgaagcataatatgatctgtggacattcggatgagaggccttatcagatgctgacctgcgctggtggacattgcaatattcttgctactgtgcatatcgtttcacatgcacgcaagaaatggcctgtatttgaacataatgtgattaccaagtgcaccatgcacataggtggtcgcaggggaatgtttatgccttaccagtgtaacatgaatcatgtgaaggtaatgttggaaccagatgccttttccagagtgagcttaacaggaatctttgatatgaatattcaactatggaagatcctgagatatgatgacactaaaccgagggtgcgcgcatgcgaatgcggaggcaagcatgctagattccagccggtgtgcgtggatgtgactgaagacctgagacccgatcatttggtgcttgcctgcactggagcggagttcggttccagtggtgaagaaactgactaaagtgagtagtggggcaagatgtggatggggactttcaggttggtaaggtggacagattgggtaaattttgttaatttctgtcttgcagctgccatgagtggaagcgcttcttttgaggggggagtatttagcccttatctgacgggcaggctcccaccatgggcaggagttcgtcagaatgtcatgggatccactgtggatgggagacccgtccagcccgccaattcctcaacgctgacctatgccactttgagttcgtcaccattggatgcagctgcagccgccgccgctactgctgccgccaacactatccttggaatgggctattacggaagcatcgttgccaattccagttcctctaataacccttcaaccctggctgaggacaagctacttgttctgttggctcagctcgaggccttaacccaacgcttaggcgaactgtctaagcaggtggcccagttgcgtgagcaaactgagtctgctgttgctacagcaaagtctaaataaagatctcaaatcaataaataaagaaatacttgtcataaaaacaaatgaatgtttatttgatttttcgcgcgcggtatgccctggaccatcggtctcgatcattgagaactcggtggatcttttccagtaccctgtaaaggtgggattgaatgtttagatacataggcattagtccgtctcgggggtggagatagctccattgaagagcctcttgctccggggtagtgttataaatcacccagtcatagcaaggtcggagtgcatggtgttgcacaatatcttttaggagcagactaattgcaacggggaggcccttagtgtaggtgtttacaaatctattgagctgggacgggtgcatccggggtgaaattatatgcattttggactggatcttgaggttggcaatgttgccgcctagatcccgtctcgggttcatattgtgcaggaccactaagacagtgtatccggtgcacttgggaaatttatcatgcagcttagagggaaaagcatgaaaaaatttggagacgcctttgtgaccccccagattctccatgcactcatccataatgatagcgatggggccgtgggcagcggcacgggcgaacacgttccgggggtctgaaacatcatagttatgctcctgagtcaggtcatcataagccattttaataaactttgggcggagggtgccagattgggggatgaaagttccctctggcccgggagcatagttcccctcacatatttgcatttcccaggctttcagttcagagggggggatcatgtccacctgcggggctataaaaaataccgtttctggagccggggtgattaactgggatgagagcaaattcctaagcagctgagacttgccgcacccagtgggaccgtaaatgaccccaattacgggttgcagatggtagtttagggagcgacagctgccgtcctcccggagtaggggggccacttcgttcatcatttcccttacatagatattttcccgcaccaagtccgttaggaggcgctctcccccaagggatagaagctcctggagcgaggagaagtttttcagcggcttcagcccgtcagccatgggcattttggaaagagtctgttgcaagagctcgagccggtcccagagctcggtgatgtgctctatggcatctcgatccagcagacctcctcgtttcgcgggttgggacggctcctggagtagggaatcagacgatgggcgtccagcgctgccagggtccgatccttccatggtcgcagcgtccgagttagggttgtttccgtcacggtgaatgggtgcgcgcctggttgggcgcttgcgagggtgcgcttcagactcatcctgctggtcgagaaccgctgccgatcggcgccctgcatgtcggccaggtagcagtttaccatgagttcgtagttgagcgcctcggccgcgtggcctttggcacggagcttacctttggaagttttatggcaggcggggcagtagatacatttgagggcatacagcttgggcgcgaggaaaatggattcgggggagtatgcattcgcaccgcaggaggcgcagacggtttcgcactccacgagccaggtcagatccggctcatcggggtcaaaaacaagttttccgccatgttttttgatgcgtttcttacctttggtttccatgaggtcgtgtccccgctgggtgacaaagaggctgtccgtgtccccgtagaccgactttatgggcctgtcctcgagcggagtgcctcggtcctcttcgtagaggaacccagcccactctgatacaaaagcgcgtgtccaggccagcacaaaggaggccacgtgggaggggtagcggtcgttgtcaaccagggggtccaccttctctacggtatgtaaacacatgtccccctcctccacatccaagaatgtgattggcttgtaagtgtaggccacgtgaccaggggtccccgccgggggggtataaaagggggcgggcctctgttcgtcctcactgtcttccggatcgctgtccaggagcgccagctgttggggtaggtattccctctcgaaggcgggcatgacctctgcactcaggttgtcagtttctaggaacgaggaggatttgatattgacagtaccagcagagatgcctttcataagactctcgtccatttggtcagaaaacacaatcttcttgttgtccagcttggtagcaaatgatccatagagggcattggatagaagcttggcgatggagcgcatggtttggttcttttccttgtccgcgcgctccttggcggcgatgttaagctggacgtactcgcgcgccacacatttccattcagggaagatggttgtcagttcatccggaactattctgactcgccatcccctattgtgcagggttatcagatccacactggtggccacctcgcctcggaggggctcattggtccagcagagtcgacctccttttcttgaacagaaaggggggagggggtctagcatgagctcatcaggggggtccgcatctatggtaaatattcccggtaacaaatctttgtcaaaatagctaatggtggtgggatcatccaaggtcatctgccattctcgaactgccagcgcgcgctcataggggttaagaggggtgccccagggcatggggtgggtgagcgcggaggcatacatgccacagatatcgtatacatagaggggctcttcgaggatgccgatgtaagtgggataacagcgcccccctctgatgcttgctcgcacatagtcatagagttcatgtgagggggcgagaagacccgggcccagattggtgcggttgggtttttccgccctgtaaacgatctggcgaaagatggcatgggaatttgaagagatagtaggtctctggaatatgttaaaatgggcatgaggtaggcctacagagtcccttatgaagtgggcatatgactcttgcagcttggctaccagctcggcggtgacgagtacatccagggcacagtagtcgagagtttcctggatgatgtcataacgcggttggcttttcttttcccacagctcgcggttgagaaggtattcttcgcgatccttccagtactcttcgaggggaaacccgtctttttctgcacggtaagagcccaacatgtagaactgattgactgccttgtagggacagcatcccttctccactgggagagagtatgcttgggctgcattgcgcagcgaggtatgagtgagggcaaaagtgtccctgaccatgactttgaggaattgatacttgaagtccatgtcatcacaggccccctgttcccagagttggaagtccacccgcttcttgtaggcggggttgggcaaagcgaaagtaacatcattgaagaggatcttgccggccctgggcatgaaatttcgggtgattctgaaaggctgagggacctctgctcggttattgataacctgagcggccaagacgatctcatcaaagccattgatgttgtgccccactatgtacagttctaagaatcgaggggtgcccctgacataaggcagcttcttgagttcttcaaaagtgagatctgtagggtcagtgagagcatagtgttcgagggcccattcgtgcacgtgagggttcgctttgaggaaggaggaccagaggtccactgcgagtgctgtttgtaactggtcccggtattgacgaaaatgctgcccgactgccattttttctggggtgacgcaatagaaggtttgggggtcctgccgccagcgatcccacttaagtttcatggcgaggtcataggcgatgttgacgagccgctggtctccagagagtttcatgaccagcatgaaggggattagctgcttgccaaaggaccccatccaggtgtaggtttccacatcgtaggtgaggaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtactcgcagcgattcacgggatgcacctcatgaatgagttgtacctgacttcctttgacgagaaatttcagtggaaaattgaggcctggcgtttgtacctggcgctctactatgttgtctgcatcggcatgaccatcttctgtctcgatggtggtcatgctgacgagccctcgcgggaggcaagtccagacctcggcgcggcaggggcggagctcgaggacgagagcgtgcaggccggagctgtccagggtcctgagacgctgcggagtcaggttagtaggcagtgtcaggagattgacttgcatgatcttttcgagggcgtgagggaggttcagatggtacttgatctccacgggtccgttggtggagatgtcaatggcttgcagggttccgtgccccttgggcgctaccaccgtgcccttgtttttccttttgggcggcggtggctctgttgcttcttgcatgtttaggagcggtgtcgagggcgcgcaccgggcggcaggggcggctcgggacccggcggcatggctggcagtggtacgtcggcgccgcgcgcgggtaggttctggtactgcgccctgagaagactcgcatgtgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcgccagagttatcctggtaggcgatctcggccatgaactgctggatctcttcctcttgaagatctccgcggcccgctctctcgacggtggccgcgaggtcgttggagatgcgcccaatgagttgagagaatgcattcatgcccgcctcgttccagacgcggctgtagaccacagcccccacgggatctctcgcgcgcataaccacctgggcgaggttaagctctacgtggcgggtgaagaccgcatagttgcataggcgctggaaaaggtagttgagtgtggtggcgatgtgctcggtgacgaagaaatacatgatccatcgtctcagcggcatctcgctgacatcgcccagcgcttccaagcgctccatggcctcgtagaagtccacggcaaagttgaaaaactgggagttacgcgcggacacggtcaactcctcttccagaagacggatgagttcggcaatggtggtgcgcacctcgcgctcgaaatcccccgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtctcggtgacggcacgaccgttctccctgggtctcagagtgaagacgcctccgcgcatctccctgaagtggtgactgggaggctctccgttgggcagggacaccgcgctgattatgcattttatcaattgccccgtaggtactccgcgcaaggacctgatcgtctcaagatccacgggatctgaaaacctttcgacgaaagcgtctaaccagtcgcaatcgcaaggtaggctgagcactgtttcttgcgggcgggggcggctagacgctcggtcggggttctctctttcttttccttcctcctcttgggaggatgagacgatgctgctggtgatgaaattaaaataggcagttttgagacggcggatggtggcgaggagcaccaggtctttgggtccggcttgttggatgcgcaggcgatgggccattccccaagcattatcctgacatctggccagatctttatagtagtcttgcatgagtcgttccacgggcacttcttcttcgcccgctctgccatgcatgcgagtgatcccgaacccgcgcatgggctggacaagtgccaggtccgctacaaccctttcggcgaggatggcttgctgcacctgggtgagggtggcttggaagtcgtcaaagtctacaaagcggtggtaggccccggtgttgattgtgtaggagcagttggccatgactgaccagttgactgtctggtgcccagggcgcacgagctcggtgtacttgaggcgcgagtatgcgcgggtgtcaaagatgtaatcgttgcaggtgcgcaccaggtactggtagccgatgagaaagtgtggcggtggctggcggtacaggggccatcgctctgtagccggggctccgggggcaaggtcttccagcatgaggcggtggtaaccgtagatgtacctggacatccaggtgataccggaggcggtggtggatgcccgcgggaactcgcgtacgcggttccagatgttgcgcagcggcatgaagtagttcatggtaggcacggtttggcccgtgagacgtgcacagtcgttgatgctctagacatacgggcaaaaacgaaagcggtcagcggctcgtctccgtggcctggaggctaagcgaacgggttgggctgcgcgtgtaccccggttcgaatctcggatcaggctggagccgcagctaacgtggtactggcactcccgtctcgacccaggcctgcacaaaacctccaggatacggaggcgggtcgtttttttgctttttcctggatgggagccagtgctgcgtcaagctttagaacactcagttctcggggctgggagtggctcgcgcccgtagtctggagaattaatcgccagggttgcgttgcggtgtgccccggttcgagtcttagcgcgccggatcggccggtttccgcgacttctccagtttacgggagcgagccctctttttttttttgttttttgttgcccagatgcatcccgtgctgcgacagatgcgcccccagcaacagcccccttctcagcagcagctacaacgacagccacaaaaggctcttcctgctcctgtaactactgcggctgcagccgtcagcggcgcgggacagcccgcctatgatctggaattggaagagggcgagggactggcgcgcctgggcgcaccatcgcccgagcggcacccgcgggtgcaactgaaaaaggactctagcgaggcgtacgtgccccagcagaacctgttcagggacaggagcggtgaggagccagaggagatgcgagcatctcgatttaacgcgggtcgcgagctgcgccacggtctggatcgaagacgggtgctgcaagacgaggattttgaggtcgatgaagtgacagggatcagcccagctagggcacatgtggccgcggccaacctagtctcagcctacgagcagaccgtgaaggaggagcgcaacttccaaaaatcttttaacaaccatgtgcgcaccctgatcgcccgcgaggaagtgaccctgggtctgatgcatctgtgggacctgatggaggctatcacccagaaccccactagcaaacccctgacagctcagctgtttctggtggttcaacatagcagggacaacgaggcattcagggaggcgttgttgaacatcaccgagcctgatgggagatggctgtatgatctgatcaacatcctgcaaagtattatagtgcaggaacgtagcctgggtttggctgagaaagtggcagctatcaactactcggtcttgagcctgggcaaatactacgctcgcaagatctacaagaccccctacgtacccatagacaaggaggtaaagatagatgggttttacatgcgcatgactctcaaggtgctgactttgagcgacgatctgggggtgtatcgcaatgacaggatgcaccgtgcggtgagcgccagcaggaggcgcgagctgagcgacagagaacttatgcacagcttgcaaagagctctaacgggggctgggaccgatggggagaactactttgacatgggagcggacttgcaatggcaacccagtcgcagggccatggaggctgcagggtgtgagcttccttacatagaagaggtggatgaagtcgaggacgaggagggcgagtacttggaagactgatggcgcgacccgtatttttgctagatggaacagcagcaggcaccggaccccgcaatgcgggcggcgctgcagagccagccgtccggcattaactcctcggacgattggacccaggccatgcaacgcataatggcgctgacgacccgcaaccccgaagcctttagacagcaaccccaggccaaccgcctttcggctatactggaggccgtagtgccctcccgctccaaccccacccacgagaaggtcctggctatcgtgaacgcgctggtggagaacaaggccatccgtcccgatgaggccgggctggtatacaatgctctcttggagcgcgtggcccgttacaacagcagcaacgtgcagaccaacctggaccggatggtgaccgatgtgcgcgaggccgtgtctcagcgcgagcggttccagcgcgacgccaacttgggatcgttggtagcgctaaacgctttcctcagcacccagcccgctaacgtgccccgtggtcagcaagactatacaaactttttgagtgcattgagactcatggtagctgaggtgcctcagagcgaggtgtaccagtccgggccagattacttcttccagaccagcagacagggcttgcagacagtgaacctgactcaggctttcaagaacctgaagggtctctggggagtgcacgccccagtaggggatcgcgcgaccgtgtctagcttgctgactcccaactcccgcctgctgctgctgctggtatccccctttactgacagcggtagcatcgaccgcaactcgtacttgggctacctgcttaacctgtatcgcgaggccatagggcagagccaggtggacgagcagacctatcaagaaatcacccaagtgagccgcgccctgggtcaggaagacacgggcagtttggaagccaccctgaacttcttgctaaccaaccggtcgcagaagatccctcctcagtatgcgcttaccgctgaggaggagcggatcctcagatacgtgcaacagagcgttggactgtttctgatgcaggagggggcgacacctaccgccgcgctggacatgacagctcgaaacatggagcccagcatgtatgctagtaacaggcctttcattaacaaactgctggactacctgcacagggcggccgccatgaactctgattatttcaccaatgctatcctgaacccacactggctgcccccacctggtttctacactggcgagtacgacatgcccgaccccaatgacgggttcctgtgggacgatgtggacagcagcatattctccccgccttttggttatacagtttggaagaaggaagggggcgatagaagacactcttccgtgtcgctgtccagaacggctggtgctgccgcgaccgtgcccgaagctgcaagtcctttccctagcttgcccttttcactaaacagcgttcgcagcagtgaactggggagaataacccgcccgcgcttgatgggcgaggatgagtacttgaatgactctttgttgaggccagagagggaaaagaacttccccaacaatggaatagagagcctggtggataagatgagtagatggaagacctatgcgcaggatcacagagacgagcccaaaatcttgggggctacaagcagaccgacccgtagacgccagcgccacgacagacagatgggtcttgtgtgggacgatgaggactctgccgatgatagcagcgtgttggacttgggtggaagaggagggggcaacccgttcgctcatctgcgtcccagattcgggcgcatgttgtaaaagtgaaagtaaaataaaaatgcaactcaccaaggccatggcgaccgagcgtgcgttcgttcttttttgttatctgtgtttagtacgatgaggagacgagccgtgctaggcggagcggtggtgtatccggagggtcctcctccttcttacgagagcgtgatgcagcaacaggcggcgatgctacagcccccactggaggttcccttcgtacccccgcggtacctggcgcctacggaagggagaaacagcattcgttactcggagctgtcgcctctgtacgataccaccaagttgtatctggtggacaacaagtcggcggacattgcctccctgaactatcagaacgaccacagcaacttcctgaccacggtggtgcagaacaatgactttacccccacggaggctagcacccagaccatcaactttgacgagcggtcgcgatggggcggtcagctgaagaccatcatgcacaccaacatgcccaacgtgaacgagtacatgttcagcaacaagttcaaggcgagggtgatggtgtccagaaaagctcctgaaggtgttatagtaaatgacacctatgatcataaagaggatatcttaaagtatgagtggtttgagttcactttaccagaaggcaacttctcagccaccatgaccattgacctgatgaacaatgccatcattgacaactacctggaaattggcagacaaaatggagtgctggaaagtgacattggtgttaagtttgacactagaaactttaggctcgggtgggaccccgaaactaagttgattatgccaggagtctacacttatgaggcattccatcctgacattgtattgctgcctggttgcggggtagactttactgaaagccgacttagcaacttgcttggcatcaggaaaagacatccattccaggagggtttcaaaatcatgtatgaagatcttgaagggggtaatattcctgcccttttggatgtcactgcctatgaggaaagcaaaaaggataccactactgaaacaaccacactggctgttgcagaggtaactagtgaagatgataatataactagaggagatacttatataactgaaaaacaaaaacgtgaagctgcagctgctgaagttaaaaaagagttaaagatccaacctctagaaaaagacagcaagagtagaagctacaatgtcttggaagacaaaatcaacacggcctaccgcagctggtacctgtcctacaattacggtaaccccgagaaaggaataaggtcttggacactgcttaccacttcagatgtcacctgtggggcagagcaggtctactggtcgctccctgacatgatgcaagacccagtcaccttccgctccacaagacaagtcaacaactacccagtggtgggtgcagagcttatgcccgtcttctcaaagagtttctacaatgagcaagccgtgtactctcagcagctccgacaggccacttcgctcacgcacgtcttcaaccgcttccctgagaaccagatcctcatccgcccgccggcgcccacaattaccaccgtcagtgaaaacgttcctgctctcacagatcacgggaccctgccgttacgcagcagtatccggggagtccagcgcgtgaccgttactgacgccagacgccgcacctgtccctacgtttacaaggccctgggcatagtcgcgccgcgcgttctttcaagccgcactttctaaaaaaaaaaaaaatgtccattctcatctcgcccagtaataataccggttggggactgtatgcgcccaccaagatgtatggaggcgcccgcatacgctctacccagcaccctgtgcgcgttcgcggtcatttccgcgctccatggggcgcactcaagggtcgtacccgcactcggaccacggtcgatgatgtgatcgaccaggtggtcgccgatgctcgtaattatactcctactgcgcctacatctactgtggatgcagttattgacagtgtggtggcagacgcccgcgcctatgctcgccggaagagccgaaggaggcgcattgccaggcgccacagggctactaccgccatgcgagctgcaaaagctattctgcggagggccaaacgtgtggggcgaagagccatgcttagagcggccagacgcgcggctttaggtgccagcagcggcaggtcccgcaggcgcgcggccacggcggcagcagcggccattgccaacatggcccaaccgcgaagaggcaatgtgtactgggtgcgtgatgccactaccggccagcgcgtgcccgtgcgcacccgcccccctcgcacttagaagatactgagcagtctccgatgttgtgtcccagcggcaagtatgtccaagcgcaaatacaaggaagagatgctccaggtcatcgcgcctgaaatctacggtccaccggtgaaggatgaaaaaaagccccgcaaaatcaagcgggtcaaaaataacaaaaaggaagaagatgacgatgatgggctggtggagtttgtgcgcgagttcgccccaagacggcgcgtgcagtggcgcgggcgcaaagtgcgtcaagtgctcagacccggaaccactgtggtttttacacctggcgagcgttccagcactacttttaaacggtcctatgatgaggtgtacggggatgacgatattcttgagcaggcggcagaccgccttgatgagtttgcttatggcaagcgcactagatccagtcccaaagaggaggctgtgtccattcccttggatcatggaaatcccacccccagcctcaaaccagtcaccttgcagcaagtgctgcccgtgcctgcgcggagaggcgtaaagcgcgagggtgaggacctatatcctaccatgcagctaatggtgcccaagcgccagaggctagaagacgtactggagaaaatgaaagtggatcccgatatccagcctgaggtcaaagtaagacctatcaaggaagtggcgccaggtttgggagtacaaaccttcgacatcaagattcccaccgagtccatggaagtgcagaccgaacctgcaaaacccacaaccacctcaattgaggtgcaaacggaaccctggacgcccgcgcccgttgtcgcccccagcaccactcgaagatcacgacgaaagtacggcccagcaagtcttctaatgcccaactatgctctgcacccatccatcattcccactccgggttacagaggcactcgctactatcgaaaccggagcaacacctctcgccgccgcaaaccacctgcaagtcgcactcgcagtcgccgccgccgcaacactgccagcaaagtgactcccgccgccctggtgcggagagtgtaccgcgatggtcgcgctgaacctctgacgctgccgcgcgcgcgctaccatccaagcatcaccacttaatgactgttgacgctgcctccttgcagatatggccctcacttgccgccttcgcgtccccattactggctaccgaggaagaaactcgcgccgtagaaggatgttggggcgagggatgcgccgccacagacgaaggcgcgctatcagcagacgattagggggtggctttttgccagctcttatacccatcatcgccgcagcgatcggggcgataccaggcatagcttccgtggcggttcaggcctcgcagcgccactaacattggaaaaaacttataaataaaaaatagaatggactctgacgctcctggtcctgtgactatgtttttgtagagatggaagacatcaatttttcatccctggctccgcgacacggcacgaggccgtacatgggcacctggagcgacatcggcacgagccaactgaacgggggcgccttcaattggagcagtatctggagcgggcttaaaaattttggctcgaccgtaaaaacctatgggaacaaagcttggaacagcagcacagggcaggctctgagaaataagcttaaggaacaaaacttccaacagaaggtggtcgatgggatcgcctctggtattaacggcgtagtggatttggccaaccaggctgtacaaaaacagataaacagccgcctggacccgccgcccgcaacccctggtgaaatggaagtggaggaagaacttcctccgctggaaaagcggggcgacaagcgtccgcgacccgagctggagcagacgctggtgacgcgcgcagacgagcccccttcatacgaggaggcagtaaagctcggaatgcccactaccaggcctgtagctcacatggctaccggggtaatgaaaccttctcagacacatcgacccgccaccttggacttgcctcctccccctgcttctgcggcacctgttcccaaacctgtcgctaccagaaagcccaccgccgtacagcccgtcgccgtagccagaccgcgcccgaaagcaaactggcaaagtactctgaacagcatcgtgggtctgggcgtgcagagtgtaaagcgccgtcgctgctattaattaaatatggagtagcgcttaacttgcttgtctgtgtgtatgtatcatcaccacgccgccgcagcagaggagaaaggaagaggtcgcgcgccgaggctgagttgctttcaagatggccaccccatcgatgatgccccaatgggcatacatgcacatcgccggacaggatgcttcggagtacctgagtccgggtctggtgcagttcgcccgtgcaacagacacctacttcagtatggggaacaagtttagaaaccccacagtggcgcccacccacgatgtgaccaccgaccgtagccagcgactgatgctgcgcttcgtgcccgttgaccgggaggacaatacatactcttacaaagtgcggtacaccctcgccgtgggcgacaacagagtgcttgacatggccagcacattctttgacattaggggggtgcttgatagaggtcctagcttcaagccatattccggcacagcttacaattcactggctcctaagggcgcgcctaacacatctcagtggatagttacaacgggagaagacaatgccaccacatacacatttggcattgcttccacgaagggagacaatattactaaggaaggtttagaaattgggaaagacattactgcagacaacaagcccatttatgccgataaaacatatcagccagagcctcaagttggagaagaatcatggactgatattgatggaacaaatgaaaaatttggaggtagagctcttaaaccagctactaaaatgaagccatgctacgggtcttttgcaagacctacaaacataaaagggggccaagctaaaaacagaaaagtaacaccaaccgaaggagatgttgaagctgaggagccagatattgatatggaatttttcgatggtagagaagctgctgacgctttttcgcctgaaattgtgctttacacggaaaatgtcaatttggaaactccagacagccatgtggtatacaagccaggaacttctgatggtaactctcatgcaaatttgggtcaacaagccatgcctaacagacccaattacattggcttcagggataactttgtaggtcttatgtactacaacagtactggaaatatgggagttttggccggccaagcatcacaactgaatgcagtggttgacttgcaggacagaaacactgaactgtcatatcagcttttgcttgattctctgggagacagaagcagatacttcagcatgtggaatcaggctgtggacagctatgatcccgatgttcgtattattgaaaatcatggcgtcgaggatgaactgcctaattactgttttcctctggatggcataggaccagggaacaaatatcaaggcattaaacctagagacactgcatgggaaaaagatactaaagtttatacagctaatgaaatagccataggcaacaatctggctatggaaattaatatccaagctaatctttggagaagttttctgtactccaatgtggctttgtaccttccagatgtttacaagtacacgccaactaacattactctgcccgctaacaccaacacctatgagtacatgaacgggcgagtggtttccccatctctggtcgattcatacatcaacattggcgccaggtggtctcttgacccaatggacaatgtgaatccatttaaccaccaccgcaatgctggcctacgctaccggtccatgcttctgggcaatggccgttatgtgcctttccacatacaagtgcctcaaaaattctttgctgtcaagaacctacttcttctacctggctcctacacctatgagtggaacttcagaaaggatgtgaacatggtcctgcaaagttcccttggaaatgacctcagaacagatggtgctaccataagtttcaccagcatcaacctctatgccaccttcttccccatggctcacaacaccgcttcaactcttgaagccatgctgcgcaacgataccaatgatcagtcattcaacgactacctctctgcagctaacatgctttaccccatccctgccaatgcaaccaacattccaatttccatcccatctcgcaactgggcagccttcaggggctggtccttcaccagactcaaaaccaaggagactccatctcttggatcagggttcgatccctacttcgtttattctggatctattccctacctggatggcactttttaccttaaccacactttcaagaaggtctccatcatgtttgactcctcagtcagctggcctggcaatgacaggctgttgtctccaaatgagtttgaaatcaagcgcactgtggatggggaaggatacaatgtggcccaatgcaacatgaccaaagactggttcctggttcagatgcttgccaactacaacattggctaccagggcttttacatccctgagggatacaaggatcgcatgtactcctttttcagaaacttccagcctatgagcaggcaggtggttgatgaggttaattacactgactacaaagccgtcaccttaccatatcaacacaacaactctggctttgtaggataccttgcgcctactatgagacaaggggaaccttacccagccaattatccatacccgctcatcggaactactgccgttaaaagtgttacccaaaaaaagttcctgtgcgacaggaccatgtggcgcataccgttctccagcaacttcatgtccatgggagcccttacggacctgggacagaacctgctctatgccaactcggcccatgcgctggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataagaagcctcttgcttcttgcaagcagcagctgcagccatgtcatgcgggtccggaaacggctccagcgagcaagagctcaaagccatcgtccgagacctgggttgcggaccctatttcctgggaacctttgacaagcgtttcccggggttcatggcccccgacaagctcgcctgcgccatagtcaacactgccggacgcgagacggggggagagcactggctggcttttggttggaacccgcgctccaacacctgctacctttttgatccttttgggttctcggatgagcgactcaaacagatttaccagtttgagtacgaggggctcctgcgccgcagtgcccttgctaccaaagaccgctgcatcaccctggaaaagtccacccagagcgtgcagggcccacgctcagccgcctgtggacttttttgctgtatgttccttcatgcctttgtgcactggcccgaccgccccatgaacggaaaccccaccatgaagttgctgactggggtgcccaacagcatgctccaatctccccaagtgcagcccaccctgcgccgcaaccaggaggcgctatatcgcttcctaaacacccactcatcttactttcgttctcaccgcgcacgcatcgaaagggccaccgcgtttgaccgtatggatatgcaataagtcatgtaaaaccgtgttcaataaaaagcactttatttttacatgcactaaggctctcgttttttactcattcgttttcattattcactcagaaatcaaatgggttctggcgggagtcaaagtgacccgcgggcagggatacgttgcggaactgtaacctgttctgccacttgaactcggggatcaccaacttgggaactggaatctcgggaaaggtgtcttgccacaactttctggtcagctgcagggcgccaagtaggtcaggagcagagatcttgaaatcacagttgggaccggcattctggacacgggagttgcggtacactgggttgcaacactggaacaccatcaaggctgggtgtctcacgcttgccagcacggtcgggtcactgatggtagtcacatccaagtcttcagcattggccatcccaaagggggtcatcttacaggtctgcctgcccatcacgggagcgcagcctggcttgtggttgcaatcgcaatgaatggggatcagcatcatcctggcttggtcgggggttatccctgggtacacggccttcatgaaggcttcgtactgcttgaaagcttcctgagccttacttccctcggtatagaacatcccacaggacttgctggaaaattgattagtagcacagttggcatcatttacacagcagcgggcatcgttgttggccaactggaccacatttctgccccagcggttctgggtgatcttggctctgtctgggttctccttcatagcgcgctgtccgttctcgctcgccacatccatctcgataatgtggtccttctgaatcatgatagtgccatgcaggcatttcaccttgccttcataatcggtgcatccatgagcccacagagcgcacccggtgcactcccaactattgtgggcgatctcagaataagaatgtaccaatccctgcatgaatcttcccatcatcactgtcagggtcttcatgctactaaatgtcagcgggatgccacggtgctcctcgttcacatactggtggcagatacgcttgtactgctcgtgctgctctggcatcagcttgaaagaggttctcaggtcattatccagcctgtacctctccattagcacagccatcacttccatgcccttctcccaggcagataccaggggcaagctcaaaggattcctaacagcaatagaagtagctcctttagctatagggtcattcttgtcgatcttctcaacacttctcttgccatccttctcaatgatgcgcaccggggggtagctgaagcccacggccaccaactgagcctgttctctttcttcttcgctgtcgtggccgatgtcttgcagagggacatgcttggtctttctgggcttcttcttgggagggatcgggggaggactgttgctccgttccggagacagggatgaccgcgaagtttcgcttaccagtaccacctggctctcgatagaagaatcggaccccacgcgacggtaggtgttcctcttcgggggcagaggtggaggcgactgagatgggctgcggtctggccttggaagcggatggctggcagagcccattccgcgttcgggggtgtgctcccgttggcggtcgcttgactgatttcctccgcggctggccattgtgttctcctaggcagagaaacaacagacatggaaactcagccatcactgccaacatcgctgcaagcgccatcacacctcgcccccagcagcgacgaggaggagagcttaaccaccccaccacccagtccagctaccaccacctctaccctcgatgatgaggaggaggaggtcgacgcagcccaggagatgcaggcgcaggataatgtgaaagcggaagagattgaggcagatgtcgagcaggacccgggctatgtgacaccggcggagcacgaggaggagctgaaacgttttctagacagagaggatgacgaccgcccagagcatcaagcagatggcgatcaccaggaggctggcatcggggatcaagttgccgactacctcaccgggcttgggggggaagacgtgctcctcaaacatctagcaaggcagtccaacatagttaaagacgcactactcgacctcaccgaagtgcccatcagtgtggaagagcttagccgcgcctacgagctgaacctcttttcgcctcacataccccccaagcggcagccaaacggcacctgcgaggccaaccctcgactgaacttctatccagcttttactgtccccgaagtgctggccacctaccacatcttttttaagaaccaaaagattccagtctcctgccgcgccaaccgcacccgcgccgatgcccttctcaacttgggtccgggagctcgcttacctgatatagcttccttggaagaggttccaaaaatctttgagggtctgggaagtgatgagactcgggccgcaaatgctctgcaacagggagagaatggcatggatgaacatcacagcgctttagtggaactggagggtgacaatgcccggcttgcagtgctcaagcgcagtatcgtggtcacccattttgcctaccccgctgttaacctgccccccaaagttatgagcgctgttatggaccatctgctcatcaaacgagcaagacccctttcagaaaaccagaacatgcaggatccagacgcctcggacgagggcaagccggtagtcagtgacgagcagctatctcgctggctgggtaccaactccccccgagatttggaagagaggcgcaagcttatgatggctgtagtgctagtaactgtggagctggagtgtctgcgccgctttttcaccgaccctgagaccctgcgcaagctagaggagaacctgcactacacctttagacatggcttcgtgcggcaggcatgcaagatctccaacgtggagcttaccaacctggtttcttacatgggcattttgcatgagaaccggctagggcagagcgtcctgcacaccacccttaaaggggaggcccgccgtgactacatccgagactgtgtctacctttacctctgccatacctggcagactggcatgggtgtgtggcaacagtgtttggaagagcagaacctaaaagagctggacaagctcttgcagagatccctcaaagccctgtggacaggttttgatgagcgcaccgtcgcctcggacctggcagacatcatcttccccgagcgtctcagggttactctgcgaaacggcctgccagactttatgagccagagcatgcttaacaactttcgctctttcatcctggaacgctccggtatcctgcctgccacctgctgtgcgctgccctccgactttgtgcctctcacctaccgcgagtgcccaccgccgctatggagccactgctacctgttccgcctggccaactacctctcctaccactcggatgttatagaggatgtgagcggagacggtctgctggaatgccactgccgctgcaatctttgcacaccccaccgctcccttgcctgcaacccccagttgctgagcgagacccagatcatcggcaccttcgagttgcagggtcccagcagtgaaggcgaggggtcttctccggggcagagtctgaaactgacaccggggctgtggacctccgcctacctgcgcaagtttcatcccgaggattaccacccctatgagatcaggttctatgaggaccagtcacatcctcccaaagtcgagctctcagcctgcgtcatcacccagggagcaattctggcccaattgcaagccatccaaaaatcccgccaagaatttctactgaaaaagggaagcggggtctaccttgacccccagaccggtgaggagctcaacacaaggttcccccaggatgtcccatcgccgaggaagcaagaagctgaaggtgcagctgacgcccccagaggatatggaggaagactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggggtccagcggcggcccaacagtagatgggacgagaccgggcgattcccaaacccgaccaccgcttccaaaaccggtaagaaggagcgacagggatacaagtcctggcgtggacacaaaaacgctatcatctcctgcttgcatgaatgcgggggcaacatatccttcacccggcgatacctgctcttccaccacggtgtgaacttcccccgcaatatcttgcattactaccgtcacctccacagcccctactgcagtcagcaagtcccggcaaccccgacagaaaaagacagcagcgacaacggtgaccagaaaaccagcagttagaaaatctacaacaagtgcagcaggaggaggactgaggatcacagcgaacgagccagcgcagaccagagagctgaggaaccggatctttccaaccctctatgccatcttccagcagagtcgggggcaagagcaggaactgaaagtaaaaaaccgatctctgcgctcgctcaccagaagttgtttgtatcacaagagcgaagaccaacttcagcgcactctggaggacgccgaggctctcttcaacaagtactgcgcgctgactcttaaagagtagcccttgcccgcgcttattcgaaaacggcgggaatcacgtcaccattggcacctgtcctttgccctagtcatgagtaaagagattcccacgccttacatgtggagctatcagccccaaatggggttggcagcaggcgcctcccaggactactccacccgcatgaattggcttagcgccgggccctcaatgatatcacgggttaatgatatacgagcttatcgaaaccagttactcctagaacagtcagctctcaccaccacaccccgccaacaccttaatccccgaaattggcccgccgccctggtgtaccaggaaactcccgctcccaccaccgtactacttcctcgagacgcccaggccgaagttcagatgactaacgcaggtgtacagctggcgggcggttccgccctatgtcgtcaccgacctcaacagagtataaaacgcctggtgatcagaggccgaggtatccagctcaacgacgagtcggttagctcttcgcttggtctgcgaccagacggagtcttccagatcgccggctgtgggagatcttccttcacccctcgtcaggctgtactgactttggagagttcgtcctcgcagccacgctcgggcggcatcggaactctccagttcgtggaggagtttactccctctgtctacttcaaccccttctccggctctcctggccagtacccagacgagttcataccgaacttcgacgcaatcagcgagtcagtggatggctatgattgatgtctaatggtggcgcggctgagctagctcgactgcgacacctagaccactgccgccgctttcgctgcttcgcccgggaactcaccgagttcatctacttcgaactccccgaggagcaccctcagggtccggcccacggagtgcggattaccatcgaagggggaatagactctcgcctgcatcgaatcttctcccagcgacccgtgctgattgagcgcgaccagggaaatacaaccatctccatttactgcatctgtaaccaccccggattgcatgaaagcctttgctgtcttgtttgtgctgagtttaataaaaactgagttaagaccctcctacggactaccgcttcttcaatcaggactttacaacaccaaccagatcttccagaagacccagacccttcctcctctgatccaggactctaactctaccttaccagcaccatccactactaaccttcccgaaactaacaagcttggatctcatctgcaacaccgcctttcacgaagccttctttctgccaatactaccactcccaaaaccggaggtgagctccgcggtctccctactgacgacccctgggtggtagcgggttttgtaacgttaggagtagttgcgggtgggcttgtgctaatcctttgctacctatacataccttgctgtgcatatttagtcatattgcgctgttggtttaaaaaatgggggccatattagtcgtgcttgctttactttcgcttttgggtctgggctctgctaatctcaatcctcttgatcacgatccatgtctagacttcgacccagaaaactgcacacttacttttgcacccgacacaagccgtctctgtggagttcttattaagtgcggatgggactgcaggtccgttgaaattacacataataataaaacatggaacaataccttatccaccacatgggagccaggagttcccgagtggtatactgtctctgtccgaggtcctgacggttccatccgcattagtaacaacacttttattttttctgaaatgtgcgatctggccatgttcatgagcagacagtatgacctatggcctcccagcaaagagaacattgtggcattttccattgcttattgcttggtaacatgcatcatcactgctatcatttgtgtgtgcatacacttgcttatagttattcgccctagacaaagcaataaggaaaaagagaaaatgccttaacctttttactcataccttttctttacagcatggcttttgttacagctctaattattgccaacattgtcactgtcgctcacgggcaaacaattatccatattaccttaggacataatcacacccttgtagggcccccaattacttcagaggttatttggaccaaacttggaagtgttgattattttgatataatttgcaacaaaactaaaccaatatttgtaatctgtaacagacaaaatctcacgttaattaatgttagcaaaatttataacggttactattatggttatgacagatccagtagtcaatataaaaattacttagttcgcataactcagcccaaattaacagtgcccactatgacaataattaaaatggctaataaagcattagaaaattttacatcaccaacaacgcccaatgaaaaaaacattccaaattcaatgattgcaattattgcggcggtggcattgggaatggcactaataataatatgcatgttcctatatgcttgttgctataaaaagtttcaacataaacagatccactactaaattttaacatttaattttttatacagatgttttccactacaatttttatcattactagccttgcagctgtaacttatggccgttcacacctaactgtacctgttggctcaacatgtacactacaaggaccccaacaaggctatgtcacttggtggagaatatatgataatggagggttcgctagaccatgtgatcagcctggtacaaaattttcatgcaacggaagagacttgaccataattaacataacatcaaatgagcaaggcttctattatggaaccaactataaagatagtttagattacaacattattgtagtgccagccaccacttctgctccccgcaaaaccactttctctagcagcagtgccaaagcaagcacaattcctaaaacagcttctgctatgttaaagcttcaaaaaatcgctttaaataattccacagccgctcccaatacaattcctaaatcaacaattggcatcattactgccgtggtagtgggattaattattatatttttgtgcataatgtactatgcctgctgctatagaaaacatgaacaaaaaggtgatgcattactaaattttgacatttaattttttatagaattatgatattgtttcaatcaaataccactaacactatcaatgtgcagactactttaaatcatgacatggaaaaccacactacctcctatgcatacacaaacattcagcctaaatacgctatgcaatagaaattctaaaagacgtcccatctattctcctatgattagtcgtccccatatggctttgaatgaaatctaagatctttttttttttctcttacagtatggtgaacaccaatcatgatccctagaaatttcttcttcaccatactcatctgtgctttcaatgtctgtgctactttcacagcagtagccactgcaagcccagactgtataggaccatttgcttcctatgcactttttgccttcgttacttgcatctgcgtgtgtagcatagtctgcctggttattaattttttccaactggtagactggatctttgtacgaattgcctacctacgtcaccatcccgaataccgcaatcaaaatgttgcggcacttcttaggcttatttaaaaccatgcaggctatgctaccagtcattttaattctgctactaccctgcattgccctagcttccaccgccactcgcgctacacctgaacaacttagaaaatgcaaatttcaacaaccatggtcatttcttgattgctaccatgaaaaatctgatttccccacatactggatagtgattgttggaataattaacatactttcatgtacctttttctcaatcacaatataccccacatttaattttgggtggaattctcccaatgcactgggttacccacaagaaccagatgaacatatcccactacaacacatacaacaaccactagcactggtagagtatgaaaatgagccacaaccttcactacctcctgccattagttacttcaacctaaccggcggagatgactgaaatactcaccacctccaattccgccgaggatctgcttgatatggacggccgcgtctcagaacagcgactcgcccaactacgcatccgccagcagcaggaacgcgtgaccaaagagctcagagatgtcatccaaattcaccaatgcaaaaaaggcatattttgcttggtaaaacaagccaagatatcctacgagatcaccgctactgaccatcgcctctcttacgaacttggcccccaacgacaaaaatttacatgcatggtgggaatcacccctatagttatcactcagcaaagtggagatactaaggggtgcattcactgctcttgcgattccatcgagtgcacctacaccctgctaaagaccctatgcggcctaagagacctgctacccatgaattaaaaattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttaactcctgtcctgtacccacaatcttcatgtctttcttcccagatgaccaagagagtccggctcagtgattccttcaaccctgtctacccctatgaagatgaaagcacctcccaacacccctttataaacccagggtttatttccccaaatggctttacacaaagcccagacggagttcttactttaaaatgtttaaccccactaacaaccacaggcgggtctctacagttaaaagtgggagggggtcttacaatagatgacaccgacggttttttgaaagaaaacataagtgccaccacaccactcgttaagactggtcactctataggtttgtcgctaggacccggattaggaacaaatgaaaacaaactttgtgccaaattgggagaaggacttacattcaattccaacaacatttgcattaatgacaatattaacaccctatggacaggagttaaccccaccagagccaactgtcaaataatggcctccagtgaatctaatgattgcaaattaattctaacactagttaaaactggagccctcgtcactgcatttgtttatgttataggagtatctaacgattttaatatgctaactacacataaaaatataaatttcactgcagagctgttttttgattctactggtaatttattaactagcctttcatccctaaaaactccacttaatcataaatcagggcaaaacatggctactggtgcccttactaatgctaaaggtttcatgcccagcacaactgcctatcctttcaatgttaattccagagaaaaagaaaactacatttacggaacttgttactacacagctagtgatcacactgcttttcccattgacacatctgtcatgcttaaccaaagagcattaaataatgagacatcatattgtattcgtgtaacttggtcctggaatacaggagttgccccagaagtgcaaacctctgctactaccctagtcacctctccatttaccttttactacattagagaagacgactgacaaataaagtttaacttgtttatttaaaatcaattcataaaattcgagtagttattttgcctcccccttcccatttaacagaatacaccaatctctccccacgcacagctttaaacatttggataccattacagatagacatagttttagattccacattccaaacagtttcaaagcgagccaatctggggtcagtgatacataaaaatgcatcgggatagtcttttaaagcgctttcacagtccaactgctgcggatgcgactccggagtctggatcacggtcatctggaagaagaacgatgggaatcataatccgaaaacggaatcgggcgattgtgtctcatcaaacccacaagcagccgctgtctgcgtcgctccgtgcgactgctgtttataggatcgggatccacagtgtcctgaagcatgattttaatagcccttaacattaactttctggtgcggtgcgcgcagcaacgcattctgatttcacttagattactacagtaggtacagcacattatcacaatattgtttaataaaccataattaaaagcgctccagccaaaactcatatcagatataatcgcccctgcatgaccatcataccaaattttaatataaattaaatgtcgttccctcaaaaacacactacccacatacataatctcttttggcatgtgcatattaacaatctgtctgtaccatggacaacgttggttaatcatgcaacccaatataaccttccgaaaccacactgccaacaccgctcccccagccatgcattgaagtgaaccctgccgattacaatgacaatgaagaacccaattctctcgaccatgaatcacttgagaataaaaaatatctatagtagcacaacaaagacataaatgcatgcatcttttcataatttttaactcctctggatttaaaaacatatcccaaggaatgggaaactcttgcagaacagtaaagctggcagaacaaggaagaccacgaacacaacttacactatgcatagtcatagtatcacaatctggcaacagcgggtggtcttcagtcatagaagctcgggtttcattttcctcacatcgtggtaactgggctctggtataagggtgatgtctggcgcatgatgtggagcgtgcgcgcaaccttgtcataatggagttgcttcctgacattctcgtattttgtatagcaaaacgcggccctggcacaacacactcttcttcgtcttctatcctgccgcttagtgtgttccgtctgataattcaagtacagccacactcttaagttggtcaaaagaatgctggcttcagttgtaattaaaactccatcatatttaattgttctaaggaaatcatccacggtagcatatgcaaatcccaaccaagcaatgcaactggattgcgtttcaagcagcagaggagagggaagagacggaagaatcatgttaatttttattccaaacgatctcgcagtacttcaaattgtagatcgcgcagatggcatctatcgcccccactgtgttggtgaaaaagcacagctaaatcaaaagaaatgcgattttcaaggtgctcaacggtggcttccaacaaagcctccacgcgcacatccaaaaacaaaagaataccaaaagaaggagcattttctaactcctcaaacatcatattacattcctgcaccattcccagataattttcagctttccagccttcaattattcgtgtcagttcttgtggtaaatccaaaccacacattacaaacaggtcccggagggcgccctccaccaccattcttaaacacaccctcataatgacaaaatatcttgctcctgtgtcacctgtagcaaattaagaatggcatcatcaattgacatgcccttggctctaagttcttctctaagttctagttgtagatactctctcatattatcaccaaactgcttagccagaagccccccgggaacaatagcaggggacgctacagtgcagtacaagcgcagacctccccaattggctccagcaaaaacaagattagaataagcatactggcaaccaccagtaatatcatcaaagttgctggaaatataatcaggcagagtttcttgtaagaattgaataaaagaaaaattttccaaaaaaacattcaaaacctctgggatgcaaatgcaataggttaccgcgctgcgctccaacattgttagttttgaattagtctgcaaaataaaagaaacaagcgtcatatcatagtagcctgtcgaacaggtggaaaaatcagtctttccatcacaagacaagccacagggtctccagctctaccctcgtaaaacctgtcatcgtgattaaacaacagcaccgaaagttcctcgcggtggccagcatgaataattcttgatgaagcatataatccagacatgttagcatcagttaaagagaaaaaacagccaacatagcctctgggtataattatgcttaatcttaagtatagcaaagccacccctcgcggatacaaagtaaaaggcacaggagaataaaaaatataattatttctctgctgctgttcaggcaacgtcgcccccggtccctctaaatacacatacaaagcctcattagccatggcttaccaggcaaagtacagccaacgcgcaaagcacaagctctaaagaagctctaaaacactctccaacctctccacaatatatacacaagccctaaactgacgtaatgagagtaaagtgtaaaaaatcccgccaaacccaacacacaccccgaaactgcgtcagcagggaaaagtacagtttcacttcctcaatcccaacaagcgtaacttcctctttctcacgatacgtcacatccgattaacttacaacgtcattttcccacggccgccccgcccattttagccgttcaccccacagccaatcaccacacagcgcgcacttttttaaattccctcatttacatattggcaccattccatctataaggtatattattgatgatg

SEQ ID NO: 584 - DNA, 35236 bp, Ad7 vaccine - NHRC vaccine tablet
ctatataatataccttatagatgttatggtgccaatatgtaaatgaggtaatttaaaaaagtgcgcgctgtgtggtgattggctgtggggttaacggctaaaatgggcggggcggccgtgggaaaatgacgtgacttatgtgggaggagctatgttgcaagttattgcggtaaatgtgacgtaaaacgaggtgtggtttgaacacggaagtagacagttttcccacgcttactgacaggatatgaggtagttttgggcggatgcaagtaaaaattctccattttcgcgcgaaaactgaatgaggaagtgaatttctgagtcatttcgcggttatgacagggtggagtatttgccgagggccgagtagactttgaccgtttacgtggaggtttcgattaccgtgtttttcacctaaatttccgcgtacggtgtcaaagtcctgtgtttttacgtaggtgtcagctgatcgctagggtatttaaacctgacgagttccgtcaagaggccactcttgagtgccagcgagaagagttttctcctccgcgccgcaagtcagttgtgcgctttgaaaatgagacacctgcgtttcctgccacaggagattatctccagtgagaccgggatcgaaatactggagtttgtggtaaataccctaatgggagacgacccggaaccgccagtgcagcctttcgatccacctacgctgcacgatctgtatgatttagaggtagacgggcctcaggatcccaatgaggaagctgtgaatgggttttttactgattctatgctgctagctgccgatgaaggattggacataaaccctcctcctgagacccttgttaccccaggggtggttgtggaaagcggcagaggtgggaaaaaattgcctgatctgggagcagctgaaatggacttgcgttgttatgaagagggttttcctccgagtgatgatgaagatggggaaactgagcagtccatccataccgcagtgaatgagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccactttatttacagtaagtgtatttaagtgaaatttaaaggaatagtgtagctgtttaataactgttgaatggtagatttatgttttttacttgtgattttttgtaggtcctgtgtctgatgatgagtcaccttctcctgattcaactacctcacctcctgaaattcaggcgcccgcacctgcaaacgtatgcaagcccattcctgtaaagcctaagcctgggaaacgccctgctgtggataagcttgaggacttgttggagggtggggatggacctttggaccttagtacccggaaactgccaaggcaataagtgccctgcagctgtgtttatttaatgtgacgtcatgtaataaaattatgtcagctgctgagtgttttattacttcttgggtggggacttggatatataagtaggagcagatctgtgtggttagctcacagcaacctgctgccatccatggaggtttgggctatcttggaagacctcagacagactaggctactgctagaaaacgcctcggacggagtctctggcctttggagattctggttcggtggtgatctagctaggctagtgtttaggataaaacaggactacagcgtagaatttgaaaagttattggacgacagtccaggactttttgaagctcttaacttgggtcatcaggctcattttaaggagaaggttttatcagttttagatttttctactcctggtagaactgctgctgctgtagcttttcttacttttatattggataaatggatccgccaaactcacttcagcaagggatacgttttggatttcatagcagcagctttgtggagaacatggaaggctcgcaggatgaggacaatcttagattactggccagtgcagcctctaggagtagcagggatactgagacacccaccgaccatgccagcggttctgcaggaggagcagcaggaggacaatccgagagccggcctggaccctccggtggaggagtagctgacctgtttcctgaactgcgacgggtgcttactaggtctacgaccagtggacagaacagaggcattaagagggagaggaatcctagtgggaataattcaagaaccgagttggctttaagtttaatgagccgcaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacaatatagaattactaagaagattaatattagaaatgcatgctacatatcagggaatggggcagaggttataatagatacacaagataaagcagcttttagatgttgtatgatgggtatgtggccaggggttgtcggcatggaagcagtaacacttatgaatattaggtttagaggggatgggtataatggcattgtatttatggctaacactaagctgattctacatggttgtagcttttttgggtttaataatacgtgtgtagaagcttgggggcaagttagtgtgaggggttgtagtttttatgcatgctggattgcaacatcaggtagggtcaagagtcagttgtctgtgaagaaatgcatgtttgagagatgtaatcttggcatactgaatgaaggtgaagcaaggatccgccactgcgcagctacagaaactggctgcttcattctaataaagggaaatgccagtgtgaagcataatatgatctgtggacattcggatgagaggccttatcagatgctgacctgcgctggtggacattgcaatattcttgctactgtgcatatcgtttcacatgcacgcaagaaatggcctgtatttgaacataatgtgattaccaagtgcaccatgcacataggtggtcgcaggggaatgtttatgccttaccagtgtaacatgaatcatgtgaaggtaatgttggaaccagatgccttttccagagtgagcttaacaggaatctttgatatgaatattcaactatggaagatcctgagatatgatgacactaaaccgagggtgcgcgcatgcgaatgcggaggcaagcatgctagattccagccggtgtgcgtggatgtgactgaagacctgagacccgatcatttggtgcttgcctgcactggagcggagttcggttccagtggtgaagaaactgactaaagtgagtagtggggcaagatgtggatggggactttcaggttggtaaggtggacagattgggtaaattttgttaatttctgtcttgcagctgccatgagtggaagcgcttcttttgaggggggagtatttagcccttatctgacgggcaggctcccaccatgggcaggagttcgtcagaatgtcatgggatccactgtggatgggagacccgtccagcccgccaattcctcaacgctgacctatgccactttgagttcgtcaccattggatgcagctgcagccgccgccgctactgctgccgccaacactatccttggaatgggctattacggaagcatcgttgccaattccagttcctctaataacccttcaaccctggctgaggacaagctacttgttctgttggctcagctcgaggccttaacccaacgcttaggcgaactgtctaagcaggtggcccagttgcgtgagcaaactgagtctgctgttgctacagcaaagtctaaataaagatctcaaatcaataaataaagaaatacttgttataaaaacaaatgaatgtttatttgatttttcgcgcgcggtatgccctggaccatcggtctcgatcattgagaactcggtggatcttttccagtaccctgtaaaggtgggattgaatgtttagatacataggcattagtccgtctcgggggtggagatagctccattgaagagcctcttgctccggggtagtgttataaatcacccagtcatagcaaggtcggagtgcatggtgttgcacaatatcttttaggagcagactaattgcaacggggaggcccttagtgtaggtgtttacaaatctattgagctgggacgggtgcatccggggtgaaattatatgcattttggactggatcttgaggttggcaaggttgccgcctagatcccgtctcgggttcatattgtgcaggaccactaagacagtgtatccggtgcacttgggaaatttatcatgcagcttagagggaaaagcatgaaaaaatttggagacgcctttgtgaccccccagattctccatgcactcatccataatgatagcgatggggccgtgggcagcggcacgggcgaacacgttccgggggtctgaaacatcatagttatgctcctgagtcaggtcatcataagccattttaataaactttgggcggagggtgccagattgggggatgaaagttccctctggcccgggagcatagttcccctcacatatttgcatttcccaggctttcagttcagagggggggatcatgtccacctgcggggctataaaaaataccgtttctggagccggggtgattaactgggatgagagcaaattcctaagcagctgagacttgccgcacccagtgggaccgtaaatgaccccaattacgggttgcagatggtagtttagggagcgacagctgccgtcctcccggagtaggggggccacttcgttcatcatttcccttacatggatattttcccgcaccaagtccgttaggaggcgctctcccccaagggatagaagctcctggagcgaggagaagtttttcagcggcttcagcccgtcagccatgggcattttggaaagagtctgttgcaagagctcgagccggtcccagagctcggtgatgtgctctatggcatctcgatccagcagacctcctcgtttcgcgggttgggacggctcctggagtagggaatcagacgatgggcgtccagcgctgccagggtccgatccttccatggtcgcagcgtccgagtcagggttgtttccgtcacggtgaatgggtgcgcgcctggttgggcgcttgcgagggtgcgcttcagactcatcctgctggtcgagaaccgctgccgatcggcgccctgcatgtcggccaggtagcagtttaccatgagttcgtagttgagcgcctcggccgcgtggcctttggcacggagcttacctttggaagttttatggcaggcggggcagtagatacatttgagggcatacagcttgggcgcgaggaaaatggattcgggggagtatgcatccgcaccgcaggaggcgcagacggtttcgcactccacgagccaggtcagatccggctcatcggggtcaaaaacaagttttccgccatgttttttgatgcgtttcttacctttggtttccatgaggtcgtgtccccgctgggtgacaaagaggctgtccgtgtccccgtagaccgactttatgggcctgtcctcgagcggagtgcctcggtcctcttcgtagaggaacccagcccactctgatacaaaagcgcgtgtccaggccagcacaaaggaggccacgtgggaggggtagcggtcgttgtcaaccagggggtccaccttctctacggtatgtaaacacatgtccccctcctccacatccaagaatgtgattggcttgtaagtgtaggccacgtgaccaggggtccccgccgggggggtataaaagggggcgggcctctgttcgtcctcactgtcttccggatcgctgtccaggagcgccagctgttggggtaggtattccctctcgaaggcgggcatgacctctgcactcaggttgtcagtttctaggaacgaggaggatttgatattgacagtaccagcagagatgcctttcataagactctcgtccatctggtcagaaaacacaatcttcttgttgtccagcttggtagcaaatgatccatagagggcattggatagaagcttggcgatggagcgcatggtttggttcttttccttgtccgcgcgctccttggcggcgatgttaagctggacgtactcgcgcgccacacatttccattcagggaagatggttgtcagttcatccggaactattctgactcgccatcccctattgtgcagggttatcagatccacactggtggccacctcgcctcggaggggctcattggtccagcagagtcgacctccttttcttgaacagaaaggggggagggggtctagcatgagctcatcaggggggtccgcatctatggtaaatattcccggtagcaaatctttgtcaaaatagctgatggtggtgggatcatccaaggtcatctgccattctcgaactgccagcgcgcgctcataggggttaagaggggtgccccagggcatggggtgggtgagcgcggaggcatacatgccacagatatcgtatacatagaggggctcttcgaggatgccgatgtaagtgggataacagcgcccccctctgatgcttgctcgcacatagtcatagagttcatgtgagggggcgagaagacccgggcccagattggtgcggttgggtttttccgccctgtaaacgatctggcgaaagatggcatgggaatttgaagagatagtaggtctctggaatatgttaaaatgggcatgaggtaggcctacagagtcccttatgaagtgggcatatgactcttgcagcttggctaccagctcggcggtgacgagtacatccagggcacagtagtcgagagtttcctggatgatgtcataacgcggttggcttttcttttcccacagctcgcggttgagaaggtattcttcgcgatccttccagtactcttcgaggggaaacccgtctttttctgcacggtaagagcccaacatgtagaactgattgactgccttgtagggacagcatcccttctccactgggagagagtatgcttgggctgcattgcgcagcgaggtatgagtgagggcaaaagtgtccctgaccatgactttgaggaattgatacttgaagtccatgtcatcacaggccccctgttcccagagttggaagtccacccgcttcttgtaggcggggttgggcaaagcgaaagtaacatcattgaagaggatcttgccggccctgggcatgaaatttcgggtgattctgaaaggctgagggacctctgctcggttattgataacctgagcggccaagacgatctcatcaaagccattgatgttgtgccccactatgtacagttctaagaatcgaggggtgcccctgacatgaggcagcttcttgagttcttcaaaagtgagatctgtagggtcagtgagagcatagtgttcgagggcccattcgtgcacgtgagggttcgctttgaggaaggaggaccagaggtccactgcgagtgctgtttgtaactggtcccggtattgacgaaaatgctgcccgactgccattttttctggggtgacgcaatagaaggtttgggggtcctgccgccagcgatcccacttaagtttcatggcgaggtcataggcgatgttgacgagccgctggtctccagagagtttcatgaccagcatgaaggggattagctgcttgccaaaggaccccatccaggtgtaggtttccacatcgtaggtgaggaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtactcgcagcgattcacgggatgcacctcatgaatgagttgtacctgacttcctttgacgagaaatttcagtggaaaattgaggcctggcgtttgtacctggcgctctactatgttgtctgcatcggcatgaccatcttctgtctcgatggtggtcatgctgacgagccctcgcgggaggcaagtccagacctcggcgcggcaggggcggagctcgaggacgagagcgcgcaggccggagctgtccagggtcctgagacgctgcggagtcaggttagtaggcagtgtcaggagattgacttgcatgatcttttcgagggcgtgagggaggttcagatggtacttgatctccacgggtccgttggtggagatgtcaatggcttgcagggttccgtgccccttgggcgctaccaccgtgcccttgtttttccttttgggcggcggtggctctgttgcttcttgcatgtttaggagcggtgtcgagggcgcgcaccgggcggcaggggcggctcgggacccggcggcatggctggcagtggtacgtcggcgccgcgcgcgggtaggttctggtactgcgccctgagaagactcgcatgtgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcgccagagttatcctggtaggcgatctcggccatgaactgctggatctcttcctcttgaagatctccgcggcccgctctctcgacggtggccgctaggtcgttggagatgcgcccaatgagttgagagaatgcattcatgcccgcctcgttccagacgcggctgtagaccacagcccccacgggatctctcgcgcgcataaccacctgggcgaggttaagctctacgtggcgggtgaagaccgcatagttgcataggcgctggaaaaggtagttgagtgtggtggcgatgtgctcggtgacgaagaaatacatgatccatcgtctcagcggcatctcgctgacatcgcccagcgcttccaagcgctccatggcctcgtagaagtccacggcaaagttgaaaaactgggagttacgcgcggacacggtcaactcctcttccagaagacggatgagttcggcaatggtggtgcgcacctcgcgctcgaaatcccccgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtctcggtgacggcacgaccgttctccctgggtctcagagtgaagacgcctccgcgcatctccctgaagtggtgactgggaggctctccgttgggcagggacaccgcgctgattatgcattttatcaattgccccgtaggtactccgcgcaaggacctgatcgtctcaagatccacgggatctgaaaacctttcgacgaaagcgtctaaccagtcgcaatcgcaaggtaggctgagcactgtttcttgcgggcgggggcggctagacgctcggtcggggttctctctttcttttccttcctcctcttgggaggatgagacgatgctgctggtgatgaaattaaaataggcagttttgagacggcggatggtggcgaggagcaccaggtctttgggtccggcttgttggatgcgcaggcgatgggccattccccaagcattatcctgacatctggccagatctttatagtagtcttgcatgagtcgttccacgggcacttcttcttcgcccgctctgccatgcatgcgagtgatcccgaacccgcgcatgggctggacaagtgccaggtccgctacaaccctttcggcgaggatggcttgctgcacctgggtgagggtggcttggaagtcgtcaaagtccacaaagcggtggtaggccccggtgttgattgtgtaggagcagttggccatgactgaccagttgactgtctggtgcccagggcgcacgagctcggtgtacttgaggcgcgagtatgcgcgggtgtcaaagatgtaatcgttgcaggtgcgcaccaggtactggtagccgatgagaaagtgtggcggtggctggcggtacaggggccatcgctctgtagccggggctccgggggcaaggtcttccagcatgaggcggtggtaaccgtagatgtacctggacatccaggtgataccggaggcggtggtggatgcccgcgggaactcgcgtacgcggttccagatgttgcgcagcggcatgaagtagttcatggtaggcacggtttggcccgtgagacgtgcacagtcgttgatgctctagacatacgggcaaaaacgaaagcggtcagcggctcgtctccgtggcctggaggctaagcgaacgggttgggctgcgcgtgtaccccggttcgaatctcggatcaggctggagccgcagctaacgtggtactggcactcccgtctcgacccaggcctgcacaaaacctccaggatacggaggcgggtcgtttttttgctttttcctggatgggagccagtgctgcgtcaagctttagaacactcagttctcggggctgggagtggctcgcgcccgtagtctggagaattaatcgccagggttgcgttgcggtgtgccccggttcgagtcttagcgcgccggatcggccggtttccgcgacgtttttaagaccccgccagccgacttctccagtttacgggagcgagccctcttttttttttttgttttttgttgcccagatgcatcccgtgctgcgacagatgcgcccccagcaacagcccccttctcagcagcagctacaacaacagccacaaaaggctcttcctgctcctgtaactactgcggctgcagccgtcagcggcgcgggacagcccgcctatgatctggaattggaagagggcgagggactggcgcgcctgggcgcaccatcgcccgagcggcacccgcgggtgcaactgaaaaaggactctcgcgaggcgtacgtgccccagcagaacctgttcagggacaggagcggtgaggagccagaggagatgcgagcatctcgatttaacgcgggtcgcgagctgcgccacggtctggatcgaagacgggtgctgcaagacgaggattttgaggtcgatgaagtgacagggatcagcccaggtagggcacatgtggccgcggccaacctagtctcagcctacgagcagaccgtgaaggaggagcgcaacttccaaaaatcttttaacaaccatgtgcgcaccctgatcgcccgcgaggaagtgaccctgggtctgatgcatctgtgggacctgatggaggctatcacccagaaccccactagcaaaccactgacagctcagctgtttctggtggttcaacatagcagggacaacgaggcattcagggaggcgttgttgaacatcaccgagcctgatgggagatggctgtatgatctgatcaacatcctgcaaagtattatagtgcaggaacgtagcctgggtttggctgagaaagtggcagctatcaactactcggtcttgagcctgggcaaatactacgctcgcaagatctacaagaccccctacgtacccatagataaggaggtaaagatagatgggttttacatgcgcatgactctgaaggtgctgactctgagcgacgatctgggggtgtatcgcaatgacaggatgcaccgcgcggtgagcgccagcaggaggcgcgagctgagcgacagagaacttatgcacagcttgcaaagagctctaacgggggccgggactgatggggagaactactttgacatgggagcggacttgcaatggcaacccagtcgcagggccatggaggctgcagggtgtgagcttccttacatagaagaggtggatgaagtcgaggacgaggagggcgagtacttggaagactgatggcgcgacccgtatttttgctagatggaacagcagcaggcaccggaccccgcaatgcgggcggcgctgcagagccagccgtccggcattaactcttcggacgattggacccaggccatgcaacgcataatggcgctgacgacccgcaaccccgaagcctttagacagcaaccccaggccaaccgcctttcggccatactggaggccgtagtgccctcccgctccaaccccacccacgagaaggtcctggctatcgtgaacgcgctggtggagaacaaggccatccgtcccgatgaggccgggctggtatacaatgctctcttggagcgcgtggcccgttacaacagcagcaacgtgcaaaccaacctggacaggatggtgaccgatgtgcgcgaggccgtgtctcagcgcgagcggttccagcgcggcgccaacttggggtcgttggtagcgctaaacgctttcctcagcacccagcccgccaacgtgccccgtggtcagcaagactatacaaactttttgagtgcattgagactcatggtagctgaggtgccccagagcgaggtgtaccagtccgggccagattacttcttccagaccagcagacagggcttgcagacagtgaacctgactcaggctttcaagaacctgaagggtctgtggggagtgcacgccccagtaggagatcgcgcgaccgtgtctagcttgctgactcccaactcccgcctgctgctgctgctggtatccccctttactgacagcggtagcatcgaccgcaactcgtacttgggctacctgcttaacctgtatcgcgaggccatagggcagagccaggtggacgagcagacctatcaagaaatcacccaagtgagccgcgccctgggtcaggaagacacgggcagtttggaagccaccctgaacttcttgctaaccaaccggtcgcagaagatccctcctcagtatgcgcttaccgctgaggaggagcggatcctcagatacgtgcaacagagcgttggactgtttctgatgcaggagggggcgacacctaccgccgcgctggacatgacagctcgaaacatggagcccagcatgtatgctagtaacaggcctttcattaacaaactgctggactacctgcacagggcggccgccatgaactctgattatttcaccaatgctatcctgaacccacactggctgcccccacctggtttctacactggcgagtacgacatgcccgaccccaatgacgggttcctgtgggacgatgtggacagcagcatattctccccgcctcccggttatacagtttggaagaaggaagggggcgatagaagacactcttccgtgtcgctgtccggaacggctggtgctgccgcgaccgtgcccgaagctgcaagtcctttccctagcttgcccttttcactaaacagcgttcgcagcagtgaactggggagaataacccgcccgcgcttgatgggcgaggatgagtacttgaatgactctttggtgaggccagagagggaaaagaacttccccaacaatggaatagagagtctggtggataagatgagtagatggaagacctatgcgcaggatcacagagacgagcccaggatattgggggctacaagcagaccgacccgtagacgccagcgccacgacagacagatgggtcttgtgtgggacgatgaggactctgccgatgatagcagcgtgttggacttgggtggaagaggagggggcaacccgttcgctcatctgcgtcccagattcgggcgcatgttgtaaaagtgaaagtaaaataaaaatgcaactcaccaaggccatggcgaccgagcgtgcgttcgttcttttttgttatctgtgtctagtacgatgaggagacgagccgtgctaggcggagcggtggtgtatccggagggtcctcctccttcttacgagagcgtgatgcagcaacaggcggcgatgatacagcccccactggaggttcccttcgtacccccgcggtacttggcgcctacggaagggagaaacagcattcgttactcggagctgtcgcccctgtacgataccaccaagttgtatctggttgacaacaagtcggcggacatcgcctccctgaactatcagaacgaccacagcaacttcctgaccacggtggtgcagaacaatgactttacccccacggaggctagcacccagaccatcaactttgacgaacggtcgcgatggggcggtcatctgaagaccatcatgcacaccaacatgcccaacgtgaacgagtacatgttcagcaacaagttcaaggcgagggtgatggtgtccagaaaagctcctgaaggtgttacagtaaatgacacctatgatcataaagaggatatcttgaagtatgagtggtttgagttcattttaccagaaggcaacttttcagccaccatgacgatcgacctgatgaacaatgccatcattgacaactacctggaaattggcagacagaatggagtgctggaaagtgacattggtgttaagtttgacactagaaatttcaggctcgggtgggaccccgaaactaagttgattatgccaggagtctacacttatgaggcattccatcctgacattgtattgctgcctggttgcggggtagactttactgaaagccgacttagcaacttgcttggcatcaggaagagacatccattccaggagggtttcaaaatcatgtatgaagatcttgaagggggtaatattcctgcccttttggatgtcactgcctatgaggaaagcaaaaaggataccactactgaaacaaccacactggctgttgcagaggaaactagtgaagatgataatataactagaggagatacctatataacagaaaaacacaaacgtgaagctgcagctgctgaagttaaaaaagagttaaagatccaacctctagaaaaagacagcaagagtagaagctacaatgtcttggaagacaaaatcaacacggcctaccgcagttggtacctgtcctacaattacggtaaccctaagaaaggaataaggtcttggacactgctcaccacttcagatgtcacctgtggggcagagcaggtttactggtcgctccctgacatgatgcaagacccagtcacgttccgctccacaagacaagtcaacaactacccagtggtgggtgcagagcttatgcccgtcttctcaaagagtttctacaatgagcaagccgtgtactctcagcagctccgacaggccacttcgctcacgcacgtcttcaaccgcttccctgagaaccagatcctcatccgcccgccggcgcccacaattaccaccgtcagtgaaaacgttcctgctctcacagatcacgggaccctgccgttacgcagcagtatccggggagtccagcgcgtgaccgttactgacgccagacgccgcacctgtccctacgtttacaaggccctgggcatagtcgcgccgcgcgttctttcaagccgcactttctaaaaaaaaaaaatgtccattctcatctcgcccagtaataataccggttggggactgtatgcgcccaccaagatgtatggaggcgcccgcaaacgctctacccagcaccctgtgcgcgttcgcggtcatttccgcgctccctggggcgcactcaagggtcgtacccgcactcggaccacggtcgatgatgtgatcgaccaggtggtcgccgatgctcgtaattatactcctactgcgcctacatctactgtggatgcagttattgacagtgtggtggcagacgcccgcgcctatgctcgccggaagagccgaaggaggcgcatcgccaggcgccacagggctactcccgccatgcgagctgcaaaagctattctgcggagggccaaacgtgtggggcgaagagccatgcttagagcggccagacgcgcggcttcaggtgccagcagcggcaggtcccgcaggcgcgcggccacggcggcagcagcggccattgccaacatggcccaaccgcgaagaggcaatgtgtactgggtgcgtgatgccactaccggccagcgcgtgcccgtgcgcactcgcccccctcgcacttagaagatactgagcagtctccgatgttgtgtcccagcggcaagtatgtccaagcgcaaatacaaggaagagatgctccaggtcatcgcgcctgaaatatacggtccaccggtgaaggatgaaaaaaagccccgcaaaatcaagcgggtcaaaaataacaaaaaggaagaagatgacgatgatgggctggtggagtttgtgcgcgagttcgccccaagacggcgcgtgcagtggcgcgggcgcaaagtgcgtcaagtgctcagacccgggaccactgtggtttttacacccggcgagcgttccagcactacttttaaacggtcctatgatgaggtgtacggggatgacaatattcttgagcaggcggcagaccgccttgacgagtttgcttatggcaagcgcactagatccagtcccaaagaggaggcggtgtccattcctttggatcatggaaatcccacccccagcctcaaaccagtcaccctgcagcaagtgctgcccgtgcctgcgcggagaggcgtaaagcgcgagggtgaggacctgtatcccaccatgcagctaatggtgcccaagcgccagaggctagaagacgtactggagaaaatgaaagtggatgccgatatccagcctgaggtcaaagtaagacctatcaaggaagtggcgccaggtttgggagtacaaaccttcgacatcaagattcccaccgagtccatggaagtgcagaccgaacctgcaaaacccacaaccacctcaattgaggtgcaaacggaaccctggatgcccgcgcccgttgccgcccccagcaccactcgaagatcacgacgaaagtacggcccagcaagtctgctaatgcccaactatgctctgcacccatccatcattcccactccgggttacagaggcactcgctactatcgaaaccggagcaacacctctcgccgccgcaaaccacctgcaagtcgcactcgccgtcgccgccgccgcaacactgccagcaaattgactcccgccgccctggtgcggagagtgtaccgcgatggtcgcgctgaacctctgacgctgccgcgcgcgcgctaccatccaagcatcaccacttaatgactgttgacgctgcctccttgcagatatggccctcacttgccgccttcgcgtccccattactggctaccgaggaagaaactcgcgccgtagaaggatgttggggcgagggatgcgccgccacagacgaaggcgcgctatcagcagacgattagggggtggctttttgccagctcttatacccatcatcgccgcagcgatcggggcgataccaggcatagcttccgtggcggttcaggcctcgcagcgccactaacattggaaaaacttataaataaaaatagaatggactctgacgctcctggtcctgtgactatgtttttgtagagatggaagacatcaatttttcatccctggctccgcgacacggcacgaggccgtacatgggcacctggagcgacatcggcacgagccaactgaacgggggcgccttcaattggagcagtatctggagcgggcttaaaaattttggctcgaccgtaaaaacctatgggaacaaagcttggaacagcagcacagggcaggctctgagaaataagcttaaggaacaaaacttccaacagaaggtggtcgatgggatcgcctctggtattaacggcgtagtggatctggccaaccaggctgtacaaaaacagataaacagccgcctggacccgccgcccgcaacccctggtgaaatggaagtggaggaagaacttcctccgctggaaaagcggggcgacaagcgtccgcgacccgagctagagcacacgctggtgacgcgcgcagacgagcccccttcatacgaggaggcagtaaagctcggaatgcccactaccaggcccgtagctcacatggctaccggggtgatgaaaccttctgagttacatcgacccgccaccttggacttgcctcctccccctgcttctgcggcgcctgttcccaaacctgtcgctaccagaaagcccaccgccgtacagcccgttgccgtagccagaccgcgtcctgggggcacaccgcgcccgaaagcaaactggcaaagtactctgaacagcatcgtgggtctgggcgtgcagagtgtaaagcgccgtcgctgctattaattaaatatggagtagcgcttaacttgcttgtctgtgtgtatgtatcatcaccacgccgccgcagcagaggagaaaggaagaggtcgcgcgccgaggctgagttgctttcaagatggccaccccatcgatgatgccccaatgggcatacatgcacatcgccggacaggatgcttcggagtacctgagtccgggtctggtgcagttcgcccgtgcaacagacacctacttcagtatggggaacaagtttagaaaccccacagtggcgcccacccacgatgtgaccaccgaccgtagccagcgactgatgctgcgcttcgtgcccgttgaccgggaggacaatacatactcttacaaagtgcggtacaccctcgccgtgggcgacaacagagtgcttgacatggccagcacattctttgacattaggggggtgcttgatagaggtcctagcttcaagccatattccggcacagcttacaattcactggctcctaagggcgcgcctaacacatctcagtggatagttacaacgggagaagacaatgccaccacatacacatttggcattgcttccacgaagggagacaatattactaaggaaggtttagaaattgggaaagacattactgcagacaacaagcccatttatgccgataaaacatatcagccagagcctcaagttggagaagaatcatggactgatattgatggaacaaatgaaaagtttggaggtagagctcttaaaccagctactaaaatgaagccatgctacgggtcttttgcaagacctacaaacataaaagggggccaagctaaaaacagaaaagtaacaccaaccgaaggagatgttgaagctgaggagccagatattgatatggaatttttcgatggtagagaagctgctgacgctttttcgcctgaaattgtgctttacacggaaaatgtcaatttggaaactccagacagccatgtggtatacaagccaggaacttctgatggtaactctcatgcaaatttgggtcaacaagccatgcctaacagacccaattacattggcttcagggataactttgtaggtcttatgtactacaacagtactggaaatatgggagttttggccggccaagcatcacaactgaatgcagtggttgacttgcaggacagaaacactgaactgtcatatcagcttttgcttgattctctgggagacagaagcagatacttcagcatgtggaatcaggctgtggacagctatgatcccgatgttcgtattattgaaaatcatggcgtcgaggatgaactgcctaattactgttttcctctggatggcataggaccagggaacaaatatcaaggcattaaacctagagacactgcatgggaaaaagatactaaagtttctacagctaatgaaatagccataggcaacaatctggctatggaaattaatatccaagctaatctttggagaagttttctgtactccaatgtggctttgtaccttccagatgtttacaagtacacgccaactaacattactctgcccgctaacaccaacacctatgagtacatgaacgggcgagtggtttccccatctctggtcgattcatacatcaacattggcgccaggtggtctcttgacccaatggacaatgtgaatccatttaaccaccaccgcaatgctggcctacgctaccggtccatgcttctgggcaatggccgttatgtgcctttccacatacaagtgcctcaaaaattctttgctgtcaagaacctacttcttctacctggctcctacacctatgagtggaacttcagaaaggatgtgaacatggtcctgcaaagttcccttggaaatgacctcagaacagatggtgctaacataagtttcaccagcatcaacctctatgccaccttcttccccatggctcacaacaccgcttcaactcttgaagccatgctgcgcaacgataccaatgatcagtcattcaacgactacctctctgcagctaacatgctttaccccatccctgccaatgcaaccaacattccaatttccatcccatctcgcaactgggcagccttcaggggctggtccttcaccagactcaaaaccaaggagactccatctcttggatcagggttcgatccctacttcgtttattctggatctattccctacctggatggcactttttaccttaaccacactttcaagaaggtctccatcatgtttgactcctcagtcagctggcctggcaatgacaggctgttgtctccaaatgagtttgaaatcaagcgcactgtggatggggaaggatacaatgtggcccaatgcaacatgaccaaagactggttcctggttcagatgcttgccaactacaacattggctaccagggcttttacatccctgagggatacaaggatcgcatgtactcctttttcagaaacttccagcctatgagcaggcaggtggttgatgaggttaattacactgactacaaagccgtcaccttaccatatcaacacaacaactctggctttgtaggataccttgcgcctactatgagacaaggggaaccttacccagccaattatccatacccgctcatcggaactactgccgttaaaagtgttacccaaaaaaagttcctgtgcgacaggaccatgtggcgcataccgttctccagcaacttcatgtccatgggagcccttacggacctgggacagaacctgctctatgccaactcggcccatgcgctggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataagaagcctcttgcttcttgcaagcagcagctgcagccatgtcatgcgggtccggaaacggctccagcgagcaagagctcaaagccatcgtccgagacctgggttgcggaccctatttcctgggaacctttgacaagcgtttcccggggttcatggcccccgacaagctcgcctgcgccatagtcaacactgccggacgcgagacggggggagagcactggctggcttttggttggaacccgcgctccaacacctgctacctttttgatccttttgggttctcggatgagcgactcaaacagatttaccagtttgagtacgaggggctcctgcgccgcagtgcccttgctaccaaagaccgctgcatcaccctggaaaagtccacccagagcgtgcagggcccacgctcagccgcctgtggacttttttgctgtatgttccttcatgcctttgtgcactggcccgaccgccccatgaacggaaaccccaccatgaagttgctgactggggtgcccaacagcatgctccaatctccccaagtgcagcccaccctgcgccgcaaccaggaggcgctatatcgcttcctaaacacccactcatcttactttcgttctcaccgcgcacgcatcgaaagggccaccgcgtttgaccgtatggatatgcaataagtcatgtaaaaccgtgttcaataaaaagcactttatttttacatgcactaaggctctcgttttttactcattcgttttcattattcactcagaaatcaaatgggttctggcgggagtcaaagtgacccgcgggcagggatacgttgcggaactgtaacctgttctgccacttgaactcggggatcaccaacttgggaactggaatctcgggaaaggtgtcttgccacaactttctggtcagctgcagggcgccaagtaggtcaggagcagagatcttgaaatcacagttgggaccggcattctggacacgggagttgcggtacactgggttgcaacactggaacaccatcaaggctgggtgtctcacgcttgccagcacggtcgggtcactgatggtagtcacatccaagtcttcagcattggccatcccaaagggggtcatcttacaggtctgcctgcccatcacgggagcgcagcctggcttgtggttgcaatcgcaatgaatggggatcagcatcatcctggcttggtcgggggttatccctgggtacacggccttcatgaaggcttcgtactgcttgaaagcttcctgagccttacttccctcggtatagaacatcccacaggacttgctggaaaattgattagtagcacagttggcatcatttacacagcagcgggcatcgttgttggccaactggaccacatttctgccccagcggttctgggtgatcttggctctgtctgggttctccttcatagcgcgctgtccgttctcgctcgccacatccatctcgataatgtggtccttctgaatcatgatagtgccatgcaggcatttcaccttgccttcataatcggtgcatccatgagcccacagagcgcacccggtgcactcccaactattgtgggcgatctcagaataagaatgtaccaatccctgcatgaatcttcccatcatcgctgtcagggtcttcatgctactaaatgtcagcgggatgccacggtgctcctcgttcacatactggtggcagatacgcttgtactgctcgtgctgctctggcatcagcttgaaagaggttctcaggtcattatccagcctgtacctctccattagcacagccatcacttccatgcccttctcccaggcagataccaggggcaagctcaaaggattcctaacagcaatagaagtagctcctttagctatagggtcattcttgtcgatcttctcaacacttctcttgccatccttctcaatgatgcgcaccggggggtagctgaagcccacggccaccaactgagcctgttctctttcttcttcgctgtcgtggccgatgtcttgcagagggacatgcttggtctttctgggcttcttcttgggagggatcgggggaggactgttgctccgttccggagacagggatgaccgcgaagtttcgcttaccagtaccacctggctctcgatagaagaatcggaccccacgcgacggtaggtgttcctcttcgggggcagaggtggaggcgactgagatgggctgcggtctggccttggaagcggatggctggcagagcccattccgcgttcgggggtgtgctcccgttggcggtcgcttgactgatttcctccgcggctggccattgtgttctcctaggcagagaaacaacagacatggaaactcagccatcactgccaacatcgctgcaagcgccatcacacctcgcccccagcagcgacgaggaggagagcttaaccaccccaccacccagtccagctaccaccacctctaccctcgatgatgaggaggaggaggtcgacgcagcccaggagatgcaggcgcaggataatgtgaaagcggaagagattgaggcagatgtcgagcaggacccgggctatgtgacaccggcggagcacgaggaggagctgaaacgttttatagacagagaggatgacgaccgcccagagcatcaagcagatggcgatcaccaggaggctggcatcggggatcaagttgccgactacctcaccgggcttgggggggaagacgtgctcctcaaacatctagcaaggcagtcgaacatagttaaagacgcactactcgacctcaccgaagtgcccatcagtgtggaagagcttagccgcgcctacgagctgaacctcttttcgcctcacataccccccaagcggcagccaaacggcacctgcgaggccaaccctcgactgaacttctatccagcttttactgtccccgaagtgctggccacctaccacatcttttttaagaaccaaaagattccagtctcctgccgcgccaaccgcacccgcgccgatgcccttctcaacttgggtccgggagctcgcttacctgatatagcttccttggaagaggttccaaaaatctttgagggtctgggaagtgatgagactcgggccgcaaatgctctgcaacagggagagaatggcatggatgaacatcacagcgctttagtggaactggagggtgacaatgcccggcttgcagtgctcaagcgcagtatcgtggtcacccattttgcctaccccgctgttaacctgccccccaaagttatgagcgctgttatggaccatctgctcatcaaacgagcaggtccactttcagaaaaccagaacatgcaggatccagacgcctcggacgagggcaagccggtagtcagtgacgagcagctatctcgctggctgggtaccaactccccccgagatttggaagagaggcgcaagcttatgatggctgtagtgctagtaactgtggagctggagtgtttgcgccgctttttcaccgaccccgagaccctgcgcaagctagaggagaacctgcactacacctttagacatggcttcgtgcggcaggcatgcaagatctccaacgtggagcttaccaacctggtttcttacatgggcattttgcatgagaaccggctagggcagagcgtcctgcacaccacccttaaaggggaggcccgccgtgactacatccgagactgtgtctacctctacctctgccatacctggcagactggcatgggtgtgtggcaacagtgtttggaagagcagaacctaaaagagctggacaagctcttgcagagatccctcaaagccctgtggacaggttttgatgagcgcaccgtcgcctcggacctggcagacatcatcttccccgagcgtctcagggttactctgcgaaacggcctgccagactttatgagccagagcatgcttaacaactttcgctctttcatcctggaacgctccggtatcctgcctgccacctgctgtgcgctgccctccgactttgtgcctctcacctaccgcgagtgcccaccgccgctatggagccactgctacctgttccgcctggccaactacctctcctaccactcggatgttatagaggatgtgagcggagacggtctgctggaatgccactgccgctgcaatctttgcacaccccaccgctcccttgcctgcaacccccagttgctgagcgagacccagatcatcggcaccttcgagttgcagggtcccagcagtgaaggcgaggggtcttctccggggcagagtctgaaactgacaccggggctgtggacctccgcctacctgcgcaagtttcatcccgaggattaccacccctatgagatcaggttctatgaggaccagtcacatcctcccaaagtcgagctctcagcctgcgtcatcacccagggagcaattctggcccaattgcaagccatccaaaaatcccgccaagaatttctactgaaaaagggaagcggggtctaccttgacccccagaccggtgaggagctcaacacaaggttcccccaggatgtcccatcgccgaggaagcaagaagctgaaggtgcagctgacgcccccagaggatatggaggaagactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggagtccagcggcggcccaacagtagatgggacgagaccgggcgattcccaaacccgaccaccgcttccaagaccggtaagaaggagcgacagggatacaagtcctggcgtggacataaaaacgctatcatctcctgcttgcatgaatgcgggggcaacatatccttcacccggcgatacctgctcttccaccacggtgtgaacttcccccgcaatatcttgcattactaccgtcacctccacagcccctactgcagtcagcaagtcccggcaaccccgacagaaaaagacagcagcgacaacggtgaccagaaaaccagcagttagaaaatctacaacaagtgcagcaggaggaggactgaggatcacagcgaacgagccagcgcagaccagagagctgaggaaccggatctttccaaccctctatgccatcttccagcagagtcgggggcaagagcaggaactgaaagtaaaaaaccgatctctgcgctcgctcaccagaagttgtttgtatcacaagagcgaagaccaacttcagcgcactctcgaggacgccgaggctctcttcaacaagtactgcgcgctgactcttaaagagtagcccttgcccgcgcttattcgaaaacggcgggaatcacgtcacccttggcacctgtcctttgccctagtcatgagtaaagagattcccacgccttacatgtggagctatcagccccaaatggggttggcagcaggcgcctcccaggactactccacccgcatgaattggcttagcgccgggccctcaatgatatcacgggttaatgatatacgagcttatcgaaaccagttactcctagaacagtcagctctcaccaccacaccccgccaacaccttaatccccgaaattggcccgccgccctggtgtaccaggaaactcccgctcccaccaccgtactacttcctcgagacgcccaggccgaagttcagatgactaacgcaggtgtacagctggcgggcggttccgccctatgtcgtcaccgacctcaacagagtataaaacgcctggtgatcagaggccgaggtatccagctcaacgacgagtcggttagctcttcgcttggtctgcgaccagacggagtcttccagatcgccggctgtgggagatcttccttcacccctcgtcaggctgtactgactttggagagttcgtcctcgcagccccgctcgggcggcatcggaactctccagttcgtggaggagtttactccctctgtctacttcaaccccttctccggctctcctggccagtacccagacgagttcataccgaacttcgacgcaatcagcgagtcagtggatggctatgattgatgtctaatggtggcgcggctgagctagctcgactgcgacacctagaccactgccgccgctttcgctgcttcgcccgggaactcaccgagttcatctacttcgaactccccgaggagcaccctcagggtccggcccacggagtgcggattaccatcgaagggggaatagactctcgcctgcatcgaatcttctcccagcgacccgtgctgattgagcgcgaccagggaaatacaaccatctccatttactgcatctgtaaccaccccggattgcatgaaagcctttgctgtcttgtttgtgctgagtttaataaaaactgagttaagaccctcctacggactaccgcttcttcaatcaggactttacaacaccaaccagatcttccagaagacccagacccttcctcctctgatccaggactctaactctaccttaccagcaccatccactactaaccttcccgaaactaacaagcttggatctcatctgcaacaccgcctttcacgaagccttctttctgccaatactaccactcccaaaaccggaggtgagctccgcggtctccctactgacgacccctgggtggtagcgggttttgtaacgttaggagtagttgcgggtgggcttgtgctaatcctttgctacctatacataccttgctgtgcatatttagtcatattgcgctgttggtttaaaaaatgggggccatattagtcgtgcttgctttactttcgcttttgggtctgggctctgctaatctcaatcctcttgatcacgatccatgtctagacttcgacccagaaaactgcacacttacttttgcacccgacacaagccgtctctgtggagttcttattaagtgcggatgggactgcaggtccgttgaaattacacataataataaaacatggaacaataccttatccaccacatgggagccaggagttcccgagtggtatactgtctctgtccgaggtcctgacggttccatccgcattagtaacaacacttttattttttctgaaatgtgcgatctggccatgttcatgagcagacagtatgacctatggcctcccagcaaagagaacattgtggcattttccattgcttattgcttggtaacatgcatcatcactgctatcatttgtgtgtgcatacacttgcttatagttattcgccctagacaaagcaataaggaaaaagagaaaatgccttaacctttttactcataccttttctttacagcatggcttttgttacagctctaattattgccaacattgtcactgtcgctcacgggcaaacaattatccatattaccttaggacataatcacacccttgtagggcccccaattacttcagaggttatttggaccaaacttggaagtgttgattattttgatataatttgcaacaaaactaaaccaatatttgtaatctgtaacagacaaaatctcacgttaattaatgttagcaaaatttataacggttactattatggttatgacagatccagtagtcaatataaaaattacttagttcgcataactcagcccaaattaacagtgcccactatgacaataattaaaatggctaataaagcattagaaaattttacatcaccaacaacgcccaatgaaaaaaacattccaaattcaatgattgcaattattgcggcggtggcattgggaatggcactaataataatatgcatgttcctatatgcttgttgctataaaaagtttcaacataaacaggatccactactaaattttaacatttaattttttatacagatgttttccactacaatttttatcattactagccttgcagctgtaacttatggccgttcacacctaactctacctgttggctcaacatgtacactacaaggaccccaacaaggctatgtcacttggtggagaatatatgataatggagggttcgctagaccatgtgatcagcctggtacaaaattttcatgcaacggaagagacttgaccataattaacataacatcaaatgagcaaggcttctattatggaaccaactataaagatagtttagattacaacattattgtagtgccagccaccacttctgctccccgcaaaaccactttctctagcagcagtgccaaagcaagcacaattcctaaaacagcttctgctatgttaaagcttcaaaaaatcgctttaaataattccacagccgctcccaatacaattcctaaatcaacaattggcatcattactgccgtggtagtgggattaattattatatttttgtgcataatgtactatgcctgctgctatagaaaacatgaacaaaaaggtgatgcattactaaattttgacatttaattttttatagaattatgatattgtttcaatcaaataccactaacactatcaatgtgcagactactttaaatcatgacatggaaaaccacactacctcctatgcatacacaaacattcagcctaaatacgctatgcaatagaaattctaaaagacgtcccatctattctcctatgattagtcgtccccatatggctttgaatgaaatctaagatcttttttttttttctcttacagtatggtgaacaccaatcatgatccctagaaatttcttcttcaccatactcatctgtgctttcaatgtctgtgctactttcacagcagtagccactgcaagcccagactgtataggaccatttgcttcctatgcactttttgccttcgttacttgcatctgcgtgtgtagcatagtctgcctggttattaattttttccaactggtagactggatctttgtacgaattgcctacctacgtcaccatcccgaataccgcaatcaaaatgttgcggcacttcttaggcttatttaaaaccatgcaggctatgctaccagtcattttaattctgctactaccctgcattgccctagcttccaccgccactcgcgctacacctgaacaacttagaaaatgcaaatttcaacaaccatggtcatttcttgattgctaccatgaaaaatctgatttccccacatactggatagtgattgttggaataattaacatactttcatgtacctttttctcaatcacaatataccccacatttaattttgggtggaattctcccaatgcactgggttacccacaagaaccagatgaacatatcccactacaacacatacaacaaccactagcactggtagagtatgaaaatgagccacaaccttcactacctcctgccattagttacttcaacctaaccggcggagatgactgaaatactcaccacctccaattccgccgaggatctgcttgatatggacggccgcgtctcagaacagcgactcgcccaactacgcatccgccagcagcaggaacgcgtgaccaaagagctcagagatgtcatccaaattcaccaatgcaaaaaaggcatattttgcttggtaaaacaagccaagatatcctacgagatcaccgctactgaccatcgcctctcttacgaacttggcccccaacgacaaaaatttacatgcatggtgggaatcacccctatagttatcactcagcaaagtggagatactaaggggtgcattcactgctcttgcgattccatcgagtgcacctacaccctgctaaagaccctatgcggcctaagagacctgctacccatgaattaaaaattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttaactcctgtcctgtacccacaatcttcatgtctttcttcccagatgaccaagagagtccggctcagtgattccttcaaccctgtctacccctatgaagatgaaagcacctcccaacacccctttataaacccagggtttatttccccaaatggctttacacaaagcccagacggagttcttactttaaaatgtttaaccccactaacaaccacaggcgggtctctacagttaaaagtgggagggggtcttacaatagatgacaccgacggttttttgaaagaaaacataagtgccaccacaccactcgttaagactggtcactctataggtttgtcgctaggacccggattaggaacaaatgaaaacaaactttgtgccaaattgggagaaggacttacattcaattccaacaacatttgcattaatgacaatattaacaccctatggacaggagttaaccccaccagagccaactgtcaaataatggcctccagtgaatctaatgattgcaaattaattctaacactagttaaaactggagccctcgtcactgcatttgtttatgttataggagtatctaacgattttaatatgctaactacacataaaaatataaatttcactgcagagctgttttttgattctactggtaatttattaactagcctttcatccctaaaaactccacttaatcataaatcagggcaaaacatggctactggtgcccttactaatgctaaaggtttcatgcccagcacaactgcctatcctttcaatgttaattccagagaaaaagaaaactacatttacggaacttgttactacacagctagtgatcacactgcttttcccattgacatatctgtcatgcttaaccaaagagcattaaataatgagacatcatattgtattcgtgtaacttggtcctggaatacaggagttgccccagaagtgcaaacctctgctactaccctagtcacctctccatttaccttttactacattagagaagacgactgacaaataaagtttaacttgtttatttaaaatcaattcataaaattcgagtagttattttgcctcccccttcccatttaacagaatacaccaatctctccccacgcacagctttaaacatttggataccattacagatagacatagttttagattccacattccaaacagtttcaaagcgagccaatctggggtcagtgatacataaaaatgcatcgggatagtcttttaaagcgctttcacagtccaactgctgcggatgcgactccggagtctggatcacggtcatctggaagaagaacgatgggaatcataatccgaaaacggaatcgggcgattgtgtctcatcaaacccacaagcagccgctgtctgcgtcgctccgtgcgactgctgtttataggatcgggatccacagtgtcctgaagcatgattttaatagcccttaacattaactttctggtgcggtgcgcgcagcaacgcattctgatttcacttagattactacagtaggtacagcacattatcacaatattgtttaataaaccataattaaaagcgctccagccaaaactcatatcagatataatcgcccctgcatgaccatcataccaaattttaatataaattaaatgtcgttccctcaaaaacacactacccacatacataatctcttttggcatgtgcatattaacaatctgtctgtaccatggacaacgttggttaatcatgcaacccaatataaccttccgaaaccacactgccaacaccgctcccccagccatgcattgaagtgaaccctgccgattacaatgacaatgaagaacccaattctctcgaccatgaatcacttgagaataaaaaatatctatagtagcacaacaaagacataaatgcatgcatcttctcataattcttaactcctcgggatttagaaacatatcccaaggaatgggaaactcttgcagaacagtaaagctggcagaacaaggaagaccacgaacacaacttacactatgcatagtcatagtatcacaatctggcaacagcgggtggtcttcagtcatagaagctcgggtttcattttcctcacatcgtggtaactgggctctggtgtaagggtgatgtctggcgcatgatgtcgagcgtgcgcgcaaccttgtcataatggagttgcttcctgacattctcgtattttgtatagcaaaacgcggccctggcacaacacactcttcttcgtcttctatcctgccgcttagtgtgttccgtctgataattcaagtacagccacactcttaagttggtcaaaagaatgctggcttcagttgtaatcaaaactccatcatatttaattgttctaaggaaatcatccacggtagcatatgcaaatcccaaccaagcaatgcaactggattgcgtttcaagcagcagaggagagggaagagacggaagaatcatgttaatttttattccaaacgatctcgcagtacttcaaattgtagatcgcgcagatggcatctatcgcccccactgtgttggtgaaaaagcacagctaaatcaaaagaaatgcgattttcaaggtgctcaacggtggcttccaacaaagcctccacgcgcacatccaaaaacaaaagaataccaaaagaaggagcattttctaactcctcaaacatcatattacattcctgcaccattcccagataattttcagctttccagccttgaattattcgtgtcagttcttgtggtaaatccaaaccacacattacaaacaggtcccggagggcgccctccaccaccattcttaaacacaccctcataatgtcaaaatatcttgctcctgtgtcacctgtagcaaattaagaatggcatcatcaattgacatgcccttggctctaagttcttctctaagttctagttgtaaatactctttcatattatcaccaaactgcttagccagaagccccccgggaacaatagcaggggacgctacagtgcagtacaagcgcagacctccccaattggctccagcaaaaacaagattagaataagcatactgggaaccaccagtaatatcatcaaagttgctggaaatataatcaggcagagtttcttgtaaaaattgaataaaagaaaaattttccaaagaaacattcaaaacctctgggatgcaaatgcaataggttaccgcgctgcgctccaacattattagttttgaattagtctgtaaaataaaagaaacaagcgtcatatcatagtagcctgtcgaacaggtggataaatcagtctttccattacaagacaagccacagggtctccagctcgaccctcgtaaaacctgtcatcgtgattaaacaacagcaccgaaagttcctcgcggtggccagcatgaataattcttgatgaagcatataatccagacatgttagcatcagttaaagaaaaaaaacagccaacatagcctctgggtataattatgcttaatcttaagtatagcaaagccacccctcgcggatacaaagtaaaaggcacaggagaataaaaaatataattatttctctgctgctgttcaggcaacgttgcccccggtccctctaaatacacatacaaagcctcatcagccatggcttaccagacaaagtatagcgggcgcacaaagcacaagctctaaagaagctctaaagacgctctccaacctctccacaatatatacacaagccctaaactgacgtaatgggagtaaagtgtaaaaaatcccgccaagcccaacacacaccccgaaactgcgtcagcagggaaaagtacagtttcacttccgcaaacccaacaagcgtaacttcctctttctcacggtacgtcacatccgattaacttgcaacgtcattttcccacggccgccccgcccattttagccgttcaccccacagccaatcaccacacagcgcgcacttttttaaattacctcatttacatattggcaccattccatctataaggtatattatatagatag

SEQ ID NO: 585 - DNA, 35522 bp, ATCC#VR-17, strain ch.79
cattatctataatataccttatagatggaatggtgccaacatgtaaatgaggtaatttaaaaaagtgcgcgctgtgtggtgattggctgcggggtgaacggctaaaaggggcgggcaatgctgggatgtgacgtaacttatgtgggaggagttatgttgcaagttatcgcggtaaaggtgacgtaaaacgaggtgtggtttggacacggaagtagacagttttcccacgtttactgacaggatatgaggtagttttgggcggatgcaagtgaaaattctccattttcgcgcgaaaactgaatgaggaagtgaatttctgagtcatttcgcggttatgacagggtggagtatttgccgagggccgagtagactttgaccgtttacgtggaggtttcgattaccgtgtttttcacctaaatttccgcgtacggtgtcaaagtcctgtgtttttacgtaggtgtcagctgatcactagggtatttaaacctgtcgagttccgtcaagaggccactcttgagtgccagcgagaagagttttctcctccgcgctgcgagtcagttttgcgctttgaaaatgagacacctgcgattcctgccacaggagattatctccagcgagaccgggatcgaaatactggagtttgtggtaaataccctgatgggagatgacccggaaccgccagtgcagcctttcgatccacctacgctgcacgatctgtatgatttagaggtagacgggcctgatgatcccaatgaggaagctgtaaatgggttttttactgattctatgctgctagctgccgatgaaggattggacataaaccctcctcctgagacccttgataccccaggggtggttgtggaaagcggcagaggtgggaaaaaattgcctgatctgggagcagctgaaatggacttgcgttgttatgaagagggttttcctccgagtgatgatgaagacggggaaactgaacagtccatccataccgcagtgaatgagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccactttatttacagtaagtgtatttaagtgaaatttaaaggaatagtgtagctgtttaataactgttgaatggtagatttatgtttttgcttgcgattttttgtaggtcctgtgtctgatgatgagtcaccttctcctgattcaactacctcacctcctgaaattcaggcgcccgtacctgcaaacgtatgcaagcccattcctgtgaagcctaagtctgggaaacgccctgctgtggataagcttgaggacttgttggagggtggggatggacctttggaccttagtacccggaaactgccaaggcaatgagtgccctgcagctgtgtttatttagtgacgtcatgtaataaaattatgtcagctgctgagtgttttattgcttcttgggtggggacttggatatataagtaggagcagatctgtgtggttagctcatagcaacctgctgccatccatggaggtttgggctatcttggaagacctgagacagactaggctactgctagaaaacgcctcggacggagtctctggcttttggagattctggttcggtggcgatctagctaggctagtgtttaggataaaacaggactatagggaagaatttgaaaagttattggacgacagtccaggactttttgaagctcttaacttgggccatcaggctcattttaaggagaaggttttatcagttttagatttttctactcctggtagaactgctgctgctgtagcttttcttacttttatattggataaatggatccgccaaacccacttcagcaagggatacgttttggatttcatagcagcagctttgtggagaacatggaaggctcgcaggatgaggacaatcttagattactggccagtgcagcctctgggagtagcagggatactgagacacccaccggccatgccagcggttctggaggaggagcagcaggaggacaatccgagagccggcctggaccctccggtggaggagtagctgacttgtttcctgaactgcgacgggtgcttactaggtctacgtccagtggacaggacaggggcattaagagggaaaggaatcctagtgggaataattcaagaaccgagttggctttaagtttaatgagccgtaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacagtatagaattactaagaagattaatattagaaatgcatgctacatatcagggaatggggcagaggttataatagatacacaagataaagcagcttttagatgttgtatgatgggtatgtggccaggggttgtcggcatggaagcagtaacatttatgaatattaggtttaaaggggatgggtataatggcattgtatttatggctaacactaagctgattctacatggttgtagcttttttgggtttaataatacttgtgtagaagcttgggggcaagttagtgtgaggggttgtagtttttatgcatgctggattgcaacatcaggtagggtcaagagtcagttgtctgtgaagaaatgcatgtttgagagatgtaatcttggcatactgaatgaaggtgaagcaagggtccgccactgcgcagctacagaaactggctgcttcattctaataaagggaaatgccagtgtgaagcataatatgatctgtggacattcgaatgagaggccttatcagatgctgacctgcgctggtggacattgcaatattctggctaccgtgcatatcgtttcccatgcacgcaagaaatggcctgtatttgaacataatgtgattaccaagtgcaccatgcacataggtggtcgcaggggaatgtttatgccttaccagtgtaacatgaatcatgtgaaggtgatgttggaaccagatgccttttccagagtaagcttaacaggaatctttgatatgaatattcaactatggaagatcctgagatatgatgacactaaaccgagggtgcgcgcatgcgaatgcggaggcaagcatgctagattccagccggtgtgcgtggatgtgactgaagacctgagacccgatcatttggtgcttgcctgcactggagcggagttcggttctagtggtgaagaaactgactaaagtgagtagtgggacgagctgtggaggtgggactttgaggttggtaaggtgggcagattgggtaaattttgttaatttctgtcttgcagctgccatgagtggaagcgcttcttttgaggggggagtatttagcccttatctgacgggcaggctcccaccatgggcaggagttcgtcagaatgtcatgggatccactgtggatgggagacccgtccagcccgccaattcctcaacgctgacctatgccactttgagttcgtcaccattggatgcagctgcagccgccgccgctactgctgccgccaacaccatccttggaatgggctattacggaagcatcgttgccaattccagttcctctaataacccttcaaccctggctgaggacaagctacttgttctcttggctcagctcgaggccttaacccaacgcttaggcgaactgtctaagcaggtggcccagttgcgtgagcaaactcagtctgctgttgccacagcaaagtctaaataaagatcttaaatcaataaataaagaaatacttgttataaaaacaaatgaatgtttatttgatttttcgcgcgcggtatgccctggaccatcggtctcgatcattgagaactcggtggatcttttccagtaccctgtaaaggtgggattgaatgtttagatacatgggcattagtccgtcccgggggtggagatagctccattgaagagcctcttgctccggggtagtgttataaatcacccagtcatagcaaggtcggagtgcatggtgttgcacaatatcttttaggagcagactaattgcaacggggaggcccttagtgtaggtgtttacaaatctgttgagctgggacgggtgcatccggggtgaaattatatgcattttggactggatcttgaggttggcaatgttgccgcctagatcccgtctggggttcatattgtgcagaaccaccaagacagtgtatccggtgcacttgggaaatttatcatgcagcttagagggaaaagcatgaaaaaatttggagacgcctttgtgaccccccagattctccatgcactcatccataatgatagcgatggggccgtgggcagcggcacgggcgaacacgttccgggggtctgaaacatcatagttatgctcctgagtcaggtcatcataagccattttaataaactttgggcgaagggtgccagattgggggatgaaagttccctctggcccgggagcatagtttccctcacatatttgcatttcccaggctttcagttcagagggggggatcatatccacctgcggggctataaaaaatactgtttctggagccggggtgattaactgggatgagagcaaattcctaagcagctgagacttgccgcacccagtgggaccgtaaatgaccccaattacgggttgcagatggtagtttagggagcgacagctgccgtcctcccggagcaggggggccacttcgttcatcatttcccttacatggatattttcccgcaccaagtccgttaggaggcgctctcccccaagggatagaagctcctggagcgaggagaagtttttcagcggcttcagcccgtcagccatgggcattttggaaagagtctgttgcaagagctcgagccggtcccagagctcggtgatgtgctctatggcatctcgatccagcagacctcctcgtttcgcgggttgggacggctcctggagtagggaatcagacgatgggcgtccagcgctgccagggtccgatccttccatggtcgcagcgtccgagtcagggttgtttccgtcacggtgaaggggtgcgcgcctggttgggcgcttgcgagggtgcgcttcagactcatcctgctggtcgagaaccgctgccgatcggcgccctgcatgtcggccaggtagcagtttaccatgagttcgtagttgagcgcctcggccgcgtggcctttggcacggagcttacctttggaagttttatggcaggcggggcagtagatacatttgagggcatacagcttgggcgcgaggaaaatggattcgggggagtatgcatccgcaccgcaggaggcgcagacggtttcgcactccacgagccatgtcagatccggctcatcggggtcaaaaacaagttttccgccatgttttttgatgcgtttcttacctttggtttccatgagttcgtgtccccgctgggtaacaaagaggctgtccgtgtccccgtagactgactttatgggcctgtcctcgagcggagtgccgcggtcctcttcgtagaggaacccagcccactctgatacaaaagcgcgtgtccaggccagcacaaaggaggccacgtgggaggggtagcggtcgttgtcaaccagggggtccaccttctctacggtatgtaaacacatgtccccctcctccacatccaagaatgtgattggcttgtaagtgtaggccacgtgaccaggggtccccgccgggggggtataaaagggggcgggcctctgttcgtcttcactgtcttccggatcgctgtccaggagcgccagctgttggggtaggtattccctctcgaaggcgggcatgacctctgcactcaggttgtcagtttctaggaacgaggaggatttgatattgacagtaccagcagagatgcctttcataagactctcgtccatctggtcagaaaacacaatcttcttgttgtccagcttggtggcaaatgatccatagagggcattggatagaagcttggcgatagagcgcatggtttggttcttttccttgtccgcgcgctccttggcggcgatgttaagctggacgtactcgcgcgccacacatttccattcagggaagatggttgtcagttcatccggaactattctgactcgccatcccctattgtgcagggttatcagatccacactggtggctacctcgcctcggaggggctcattggtccagcagagtcgacctccttttcttgaacagaaaggggggagggggtctagcatgaactcatcaggggggtccgcatctatggtaaatattcccggtagcaaatccttgtcaaaatagctgatggtggcgggatcatccaaagtcatctgccattctcgaactgccagcgcgcgctcataggggttaagaggggtgccccagggcatggggtgggtgagcgcggaggcatacatgccacagatatcgtagacatagaggggctcttcgaggatgccgatgtaagtgggataacagcgcccccctctgatgcttgctcgcacatagtcatagagttcatgtgagggggcgagaagacccgggcccagattggtgcggttgggtttttccgccctgtaaacgatctggcgaaagatggcatgggaattggaagagatagtaggtctctggaatatgttaaaatgggcatgagggaggcctacagagtcccttatgaagtgggcatatgactcttgcagcttggctaccagctcggcggtgacaagtacgtctagggcacagtagtcgagagtttcctggatgatgtcataacgcggttggtttttcttttcccacagctcgcggttgagaaggtattcttcgcgatccttccagtactcttcgaggggaaacccgtctttttctgcacggtaagagcccaacatgtagaattgattgactgccttgtagggacagcatcccttctccactgggagagagtatgcttgggctgcattgcgcagcgaggtatgagtgagggcaaaagtgtccctgaccatgactttgaggaattgatacttgaagtcgatgtcatcacaggccccctgttcccagagttggaagtccacccgcttcttgtaggcggggttgggcaaagcgaaagtaacatcattgaagaggatcttgccggccctgggcataaaatttcgggtgattctgaaaggctgagggacctctgctcggttattgataacctgagcggccaagacgatctcatcaaagccattgatgttgtgccccactatgtacagttctaagaatcgaggtgtgcccctgacatgaggcagcttcttgagttcttcaaaagtgaggtctgtagggtcagtgagagcatagtgttcgagggcccattcgtgcaggtgagggttcgctttgaggaaggaggaccagaggtccactgccagtgctgtttgtaactggtcccggtactgacgaaaatgctgcccgactgccatcttttctggggtgacgcaatagaaggtttgggggtcctgctgccagcgatcccacttgagttttatagccaggtcataggcgatgttgacgagccgctggtctccagagagtttcatgaccagcatgaaggggattagctgcttgccaaaggaccccatccaggtgtaggtttccacatcgtaggtgaggaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtactcgcatcgattcacgggatgcacctcatgaatgagttgtacctgacttcctttgacgagaaatttcagtggaaaattgaggcctggcgcttgtacctcgcgctctactatgttgtctgcatcggcatgaccatcttctgtctcgatggtggtcatgctgacgagccctcgcgggaggcaagtccagacctcggcgcggcaggggcggagctcgaggacgagagcgcgcaggtcggagctgtccagggtcctgagacgctgcggagtcaggttagtaggcagtgtcaggagattgacttgcatgatcttttcgagggcgtgagggaggttcagatggtacttgatctccacgggtccgttggtggagatgtcgatggcttgcagggttccgtgccccttgggcgctaccaccgtgcccttgtttttccgtttgggcggcggtggctctgttgcttcttgcatgtttagaagcggtgtcgagggcgcgcaccgggcggcaggggcggctcgggacccggcggcatggccggcagtggtacgtcggcgccgcgcgcgggtaggttctggtactgcgccctgagaagacttgcatgcgcgacgacgcggcggttgacatcctggatctgacgcctctgggtgaacgctaccggccccgtgagcttgaacctgaaagagagttcaacagaatcaatctcggtatcgttgacggcggcttgcctaaggatttcttgcacgtcgccagagttgtcctggtaggcgatctcggccatgaactgctcgatctcttcctcttgaagatctccgcggcccgctctctcgacggtggccgcaaggtcgttggagatgcgtccaatgagttgagagaatgcattcatgcccgcctcgttccagacgcggctgtagaccacagccccctcgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctaacatcgcccagcgcttccaagcgctccatggcctcgtagaagtccacggcaaagttgaaaaactgggagttacgcgcggacacggtcaactcctcttccagaagacggatgagttcggcgatggtggtgcgcacctcgcgctcgaaagcccccgggatttcttcctcaatttcttcttcttccactaacatctcttcctcttcaggtggggctgcaggaggagggggaacgcggcgacgccggcggcgcacaggcagacggtcgatgaatctttcaatgacctctccgcggcggcggcgcatggtctcggtgacggcacgaccgttctccctgggtctcagagtgaagacgcctccgcgcatctccctgaagtggtgactgggaggctctccgttgggcagggacaccgcgctgattatgcattttatcaattgccccgtaggtactccgcgcaaggacctgatcgtctcaagatccacgggatctgaaaacctttcgacgaaagcgtctaaccagtcgcaatcgcaaggtaggctgagcactgtttcttgcgggcgggggcggctagacgctcggtcggggttctctctttcttctccttcctcctctttggagggtgagacgatgctgctggtgatgaaattaaaataggcagttttgagacggcggatggtggcgaggagcaccaggtctttgggtccggcttgttggatgcgcaggcgatgggccattccccaagcattatcctgacatctggccagatctttatagtagtcttgcatgagtcgttccacgggcacttcttcttcgcccgctctgccatgcatgcgagtgatcccgaacccgcgcatgggctggacaagtgccaggtccgctacaaccctttctgcgaggatggcttgctgcacctgggtgagggtggcttggaagtcgtcaaagtccacgaagcggtggtaagccccggtgttgattgtgtaggagcagttggccatgactgaccagttgactgtctggtgccccggacgcacaatctcggtgtacttgaggcgcgagtaggcgcgggtgtcaaagatgtaatcgttacaggtgcgcaccaggtactggtagccgatgagaaagtgaggcggcggctggcggtataggggccatcgctctgtagccggggcgccaggggcgaggtcttccagcatgaggcggtgataaccgtagatgtacctggacatccaggtgataccggaggcggtggtggatgcccgcgggaactcgcgtacgcggttccagatgttgcgcagcggcatgaagtagttcatggtaggcacggtttggcccgtgagacgcgcacagtcgttgatgctctagacatacgggcaaaaacgaaagcggtcagcggctcgtctccgtggcctggaggctaagcgaacgggttgggctgcgcgtgtaccccggttcgaatctcggatcaggctggagccgcagctaacgtggtactggcactcccgtctcgacccaggcctgcacaaaacctccaggatacggaggcgggtcgttttttttttgctttttcctggatgggagccagtgctgcgtcaagctttagaacactcagttctcggggctgggagtggctcgcgcccgtagtctggagaatcaatcgccagggttgcgttgcggtgtgccccggttcgagtcttagcgcgccggatcggccggtttccgcgacaagcgagggtttggcagcctcgtcatttctaagaccccgccagccgacttctccagtttacgggagcgagccctcttttttttgttttttgttgcccagatgcatcccgtgctgcgacagatgcgcccccagcaacagcccccttctcagcagcagctacaacaacagccacaaaaggctcttcctgctcctgtaactactgcggctgcagccgtcagcggcgcgggacagcccgcctatgatctggacttggaagagggcgagggattggcgcgcctgggggctccatcgcccgagcggcacccgcgggtgcaactaaaaaaggactctcgcgaggcgtacgtgccccaacagaacctattcagggacaggagcggcgaggagccagaggagatgcgagcatctcgatttaacgcgggtcgcgagctgcgccacggtctggatcgaagacgggtgctgcaagacgaggattttgaggtcgatgaagtgacagggatcagcccagctagggcacatgtggccgcggccaacctagtctcggcctacgagcagaccgtgaaggaggagcgcaacttccaaaaatcttttaacaaccatgtgcgcaccctgatcgcccgcgaggaagtgaccctgggtctgatgcacctgtgggacctgatggaggctatcacccagaaccccactagcaaacccctgacagctcagctgtttctggtggttcaacatagcagggacaacgaggcattcagggaggcgttgttgaatatcaccgagcctgatgggagatggctgtatgatctgattaacatcctgcaaagtattatagtgcaggaacgtagcctgggtttggctgagaaagtggcagctatcaactactcggtcttgagcctgggcaaatactacgctcgcaagatctacaagaccccctacgtacccattgacaaggaggtgaagatagatgggttttacatgcgcatgactctcaaggtgttgactttaagcgacgatctgggggtgtatcgcaatgacaggatgcaccgcgcggtgagcgccagcaggaggcgcgagctgagcgacagagaacttatgcacagcttgcaaagggctctaacgggggccggaactgatggggagaactactttgacatgggagcggacttgcaatggcaacccagtcgcagggccatggaggctgcagggtgtgagcttccttacatagaagaggtggatgaagtcgaggacgaggagggcgagtacttggaagactgatggcgcgacccgtatttttgctagatggaacaacagcaggcaccggaccccgcaatgcgggcggcgctacagagccagccgtccggcattaactcctcggacgattggacccaggccatgcaacgtataatggcgctgacgacccgcaaccccgaagcctttagacagcaaccccaggccaaccgcctttcggccatactggaggccgtagtgccctcccgctccaaccccacccacgagaaggtcctggctatcgtgaacgcgctggtggagaacaaggccatccgtcccgatgaggccgggctggtatacaatgctcttttggagcgcgtggcccgttacaacagcagcaacgtgcagaccaacctggaccggatggtgaccgatgtgcgcgaggctgtgtctcagcgcgagcggttccagcgcgacgccaacttggggtcattggtagcgctaaacgctttccttagcacccagcccgccaacgtgccccgtggtcagcaagactatacaaactttttgagtgcattgagactcatggtatctgaggtgccccagagcgaggtgtaccagtccgggccagattacttcttccagaccagcagacagggcttgcagacagtgaacctgacccaggctttcaagaacctgaagggtctgtggggagtgcacgccccagtaggagatcgcgcgaccgtgtctagcttgctgactcccaactcccgcctgctgctgctgctggtatcccccttcactgacagcggtagcatcgaccgcaactcctacttgggctacctgcttaacctgtatcgcgaggctataggacagagccaggtggacgagcagacctatcaagaaatcacccaagtgagccgcgccctgggtcaggaagacacaggcggtttggaagccaccctgaacttcttactaaccaaccggtcgcagaagatccctcctcagtatgcgcttaccgctgaggaggagcggatcctaagatacgtgcaacagagcgttggactgtttttgatgcaggagggggcgacacctaccgccgcgctggatatgacagctcgaaacatggagcccagcatgtatgctagtaacaggcctttcattaacaaactgctggactacctgcacagggcggccgccatgaactctgattatttcaccaatgctattctgaacccacactggctgcccccacctggtttctacactggcgaatacgacatgcccgatcccaatgacgggttcctatgggacgatgtggacagtagcatattttccccgccgccaggttatacggtttggaagaaggaagggggcgatagaaggcactcttccgtatcgttgcccggaacggctggtgctgccgcggccgtgcccgaagctgcgagtcctttccctagcttgtccttttcactaaacagcgttcgcagcagtgaactggggagaataaaccgcccgcgcttgatgggcgaggatgagtacttgaatgactctttgctgaggccagagagggaaaagaacttccctaacaatggaatagagagcctggtggataagatgagtagatggaagacctatgcgcaggatcacagagacgagcccaggatcttgggggctacaagcagaccgagccgtagacgccagcgccacgacaggcagatgggtcttgtgtgggacgacgaggactctgccgatgacagcagcgtgttggacttgggtggaaaaggagttggcaacccgttcgctcatctgcgtccccgtttcggtcgcatgttgtaaaagtgaaagtaaaaataaaaaggcaactcaccaaggccatggcaaccgagcgtgcgttcgttcttttttttgttatctgtatctagtacgatgaggagacgagccgtgctaggcggagcggtggtgtatccggagggtcctcctccttcttacgagagcgtgatgcagcaacaggcggcgatgatacagcccccactggaggctcccttcgtaccccctcggtacctggcgcctacggaagggagaaatagcattcgttactcggagctgtcaccccagtacgataccaccaagttgtatctggtggacaacaagtcggcggacatcgcctccctgaactatcagaacgaccacagcaacttcctgaccacagtggtgcagaacaatgactttacccccacggaggctagcacccagaccattaactttgacgagcggtcgcggtggggcggtcagctgaagaccattatgcacaccaacatgcccaacgtgaacgagtacatgttcagcaacaagtttaaggcgagggtgatggtatctaggaaggctcctgaaggtgttacagtaaatgatcataaagatgatattttgaaatatgagtggtttgagttcactttaccagaaggtaacttctcagctaccatgaccatcgacctgatgaacaatgccatcattgacaactacctgaaaattggcagacagaatggagtgctggaaagtgacattggtgttaagtttgacactagaaacttcaggctcgggtgggaccccgaaactaagttgattatgccaggggtctacacttatgaggcattccatcctgacattgttttgttgcctggttgcggggtagattttactgaaagccgacttagcaacttgcttggcatcaggaagagacatccattccaggagggtttcaaaatcatgtatgaagatcttgaagggggtaatattcctgcccttttggatgtcactgcctatgaggaaagcaaaaaggataccactactgaaacaggcgaaaaggcggtggttaaaacaaccacagtggctgttgcagaggaaaccagtgaagatgataatataactagaggagatacttatataactgaaaaacaaaaacgtgaagctgcagctgcagaactattacttatgtctgaagttaaaaaagagttaaagatccaacctttagaaaaagacagcaagaatagaagctacaatgtcttggaagacaaaatcaacacagcctaccgcagctggtacctgtcctacaattatggtaaccctgagaaaggaataaggtcctggacactgctcaccacttcggatgtcacctgtggagccgagcaggtctactggtcgctccccgacatgatgcaagaccccatcaccttccgctcctcgagacaagtcaacaactacccagtagtgggtgcagagcttatgccggtcttctcaaagagtttctacaatgagcaagccgtgtactctcagcagctccgacagtccacctcgctcacgcacgtcttcaaccgcttccctgagaaccagatcctcatccgcccgccggcgcccacaattaccaccatcagtgaaaacgttcctgctctcacagatcacgggaccctgccgttacgcagcagtatccggggagtccagcgcgtgaccgttactgacgccagacgtcgcacctgtccctacgtttacaaggccctgggcatagtcgcgccgcgcgttctttcaagccgcactttctaaaaaaaaaaaaaaatgtccattctcatctcgcccagtaataataccggttggggactgcatgcgcccaccaagatgtacggaggcgcccgcaaacgctctacccagcaccccgtgcgcgttcgcggtcatttccgcgctccctggggcgccctcaagggccgtacccgcactcggaccacggtcgatgatgtgatcgaccaggtggttgccgatgctcgtaattatactcctactgcgcctacatctactgtggatgcagttattgacagtgtagtggcagacgctcgcgcctatgctcgccggaagagccgaaggaggcgcatcgccaggcgccacagggctactcccgctatgcgagctgcaaaagctattctgcggagggccaaacgtgtgggacgaagagccatgcttagagcggccagacgcgcggcttctggtgctagcagcggcaggtcccgcaggcgcgcggccacggcggcagcagcggccattgccaacatggcccaaccgcgaagaggcaatgtgtattgggtgcgcgatgccactaccggccagcgcgtgcccgtgcgcacccgcccccctcgcacttagaagatactgagcagtctccgatgttgtgtcccagcggcaagtatgtccaagcgcaaatacaaggaagagatgctccaggtcatcgcgcctgaaatctacggtccgccgatgaaggatgaaaaaaagccccgcaaaatcaagcgggttaaaaaggacaaaaaagaagaagatggcgatgatggactggtggagtttgtgcgcgagttcgcgccaagacggcgcgtgcagtggcgcggtcgaaaagtacgccaagtgcttagacccgggaccactgtggtctttacacctggcgagcgttccagcactacttttaaacggtcctatgatgaggtgtatggggatgacgatattattgagcaggcggcagaccgccttggcgagtttgcttatggcaagcgcacaagatccagtcccaaagaggaggcggtatctattcccttggatcatggaaatcccacccctagcctcaaaccagtcaccctgcagcaagtgctgcccgtacctgcgagcagaggcgtaaagcgcgagggtgaggacctatatcccaccatgcagctaatggtgcccaagcggcagagattagaagacgtactggagaaaatgaaagtggatgccgatatccagcctgaggtgaaagtgagacccatcaaggaagtggcgccaggtttgggagtacaaacctttgacatcaagattcccactgagtccatggaagtgcagaccgaacctgcaaaacccacagtcacctcaattgaggttcagacggaaccctggatgcccgcgcccgttgccgcccccagcaccactagaagatcacgtcgaaagtatggcccagcaagtctgctaatgcccaactatgctctgcacccatccatcattcccactccgggttacagaggcactcgctactatcgaagtcggagcaacacctcacgccgccgcaaactacctgcaagtcgcactcgccgtcgccgccgccgcaccactgccagcaaattaactcccgccgccctggtgcggagagtgtaccgcgatggtcgcgctgaacctctgacgctgccgcgcgcgcgctatcatccaagcatcaccacttaatgactgttgacgctgcctccttgcagatatggctctcacttgccgccttcgcgtccccattactggctaccgaggaagaaactcgcgccgtagaaggatgttggggcgagggatgcgccgccacagacgaaggcgcgctatcagcaagcgattagggggtggctttctgccagctcttatacccatcatcgccgcggcgatcggggcgataccaggcatagcttccgtggcggttcaggcctcgcagcgccactaacaatggaaaaatttataaataaaaaatagaatggactctgacgctcctggtcctgtgactatgtttttgtagagatggaagacatcaatttttcatccctggctccgcgacacggcacgaggccgtacatgggcacctggagcgacatcggcacgagccaactgaacgggggcgccttcaattggagcagtatctggagcgggcttaaaaattttggctcgaccataaaaacctatgggaacaaagcttggaacagcagcacagggcaggcccttagaaataagcttaaggagcagaacttccaacaaaaggtggtcgatggtatcgcctctggtattaacggcgtagtggatctagccaaccaggctgtgcagaaacagataaacagccgcctggacccgccgcccgcaactcctggtgaaatggaagtggaggaagagcttcctccgctggagaagcggggcgacaagcgaccgcgtcccgagctggaacagacgttggtgacgcgcgcagacgagcccccttcatacgaggaggcagtaaagctcggaatgcccactaccaggcctgtagctcacatggctaccggggtgatgaaaccttctcagtcgcatcggcctgccaccttggacttgcctcctccccctgcttctgcggcgcctattcccaaacctgtcgctaccagaaagcccaccgccgtacagcccgtcgccgtagccagaccgcgtcctggggcacaccgcgcccgaaagcaaactggcagagtactctgaacagcatcgtgggtctgggcgtgcagagtgtaaagcgccgtcgctgctattaattaaatatggagtagcgcttaacttgcttgtctgtgtgtatgtatcatcaccatgccgccgcagcagaggagaaaggaagaggtcgcgcgccgaggctgagttgctttcaagatggccaccccatcgatgatgccccaatgggcatacatgcacatcgccggacaggatgcttcggagtacctgagtccgggtctggtgcagttcgcccgtgcaacagacacctacttcagtatggggaacaagtttagaaaccccacagtggcgcccacccacgatgtgaccaccgaccgtagccagcgactaatgctgcgcttcgtgcccgttgaccgggaagacaatacctactcttacaaagttcgctacacgctggctgtaggggacaacagagtactggatatggccagcacgttctttgacatccgcggcgtgctggaccggggccctagcttcaaaccctactccgggaccgcctacaacagcctggctcccaagggagcgcccaacacctgccagtggaaggattctgacagcaaaatgcatacctttggggtagctgccatgcccggtgttactgggaaaaagatagaagctgatgggctgcctattggaatagattcaacttctggaactgacacagtaatttatgctgataaaactttccaaccagaaccacaagttggaaatgccagttgggttgacgccaatggtacagaggaaaaatatggaggcagagctctgaaggacactacaaagatgaaaccctgctatggttctttcgccaagcctaccaacaaagaaggtggtcaggctaacttaaaagattcagaaaccgccgccaccactcctaactatgatatagatctggctttctttgacaacaaaaatattgctgctaactacgatccagatattgtaatgtacacagaaaatgttgacttgcagactccagatactcatattgtatacaaacctggaacagaggacaccagctctgaatccaatttgggtcagcaagccatgcctaacagacccaactacattggcttcagagacaattttattgggctcatgtactacaacagcactggcaatatgggggtgctggccggtcaggcctctcagctgaatgctgtggttgacttgcaagacagaaacactgaactgtcctaccagctcttgcttgactctctgggtgacagaacccggtatttcagtatgtggaatcaggcggtggacagctatgatcctgatgtgcgtattattgaaaaccatggtgtggaggacgaattgccaaactattgctttccgttgaatggtgtgggatttacagacacttaccaaggtgttaaagttaaaacagatgcagttgctggaaccagtggaacacagtgggacaaagatgacaccacagttagtactgctaatgaaatccatggaggcaatccttttgccatggaaatcaacatccaagccaatctatggcgaagtttcctttattccaatgtggctttgtatctcccagactcgtataaatacaccccgtccaatgtcactctcccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtaaacatggttctacagagttcccttggtaacgacctacgggtagatggcgccagcatcagtttcacgagcatcaatctttatgctacttttttccccatggctcacaacaccgcttccacccttgaagccatgctgcggaatgacaccaatgatcagtcattcaacgactacctatctgcagctaacatgctctaccccatacctgccaacgcaaccaatattcccatttccattccttctcgcaactgggcggctttcagaggctggtcatttaccagactgaaaaccaaagaaactccctctttggggtctggatttgacccatactttgtctattccggttctattccctacctggatggtaccttctatctaaatcacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacattggctaccagggcttttacatccctgagggatacaaggatcgcatgtactcctttttcagaaacttccagcctatgagcaggcaggtggttgatgaggttaattacactgactacaaagccgtcaccttaccatatcaacacaacaactctggctttgtaggataccttgcgcctactatgagacaaggggaaccttacccagccaattatccatacccgctcatcggaactactgccgttaagagtgttacccaaaaaaagttcctgtgcgacaggaccatgtggcgcataccgttctccagcaacttcatgtccatgggggcccttacagacctgggacaaaacctgctctatgccaactcggcccatgcactggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataagaagcctcttgcttcttgcaagcagcagctgcagccatgtcatgcgggtccggaaacggctccagcgagcaagagctcaaagccatcgtccgagacctgggttgcggtccctatttcctgggaacctttgacaagcgtttcccggggttcatggcccccgacaagctcgcctgcgccatagtcaacactgccggacgcgagacggggggagagcactggctggcttttggttggaacccgcgctccaacacctgctacctttttgatccttttgggttctcggatgagcgactcaaacagatttaccagtttgagtacgaggggctcctgcgccgcagtgcccttgctaccaaagaccgctgcatcaccctggaaaagtccacccagagcgtgcagggcccacgctcagccgcctgtggacttttttgctgtatgttccttcatgcctttgtgcactggcccgaccgtcccatgaacggaaaccccaccatgaagttgctgactggggtgcccaacagcatgctccaatctccccaagtccagcccaccctgcgccgcaaccaggaggcactataccgcttcctaaacacccactcatcttactttcgttctcaccgcgcacgcatcgaaagggccaccgcgtttgaccgtatggatatgcaataagtcatgtaaaaccgtgttcaataaaaagcactttatttttacatgcactaaggctctggttttttgctcattcgttttcatcattcactcagaaatcaaatgggttctggcgggagtcatagtggcccgcgggcagggatacgttgcggaactgtaacctgttctgccacttgaactcggggatcaccagcttgggaactggaatctcgggaaaggtgtcttgccacaactttctggtcagttgcagggcgccaagcaggtcaggagcagagatcttgaaatcacagttggggccggcattctggacacgggagttgcggtacactgggttgcaacactggaacaccatcaaggctgggtgtctcacgcttgccagcacggtcgggtcactgatggtagtcacatccaagtcttcagcattggccatcccaaagggggtcatcttacaggtctgcctgcccatcacgggagcgcagcctggcttgtggttgcaatcgcaatgaatgggaatcagcatcatcctggcttggtcgggggttatccctggatatacggccttcatgaaggcttcgtactgcttgaaagcttcctgagccttacttccctcggtgtagaacattccacaggacttgctggaaaattggttagtagcacagttggcatcatttacacagcagcgggcatcgttgttggccaactgaaccacatttctgccccagcggttctgggtgatcttggctctgtctgggttctccttcatagcgcgctgcccgttctcgctcgccacatccatctcgataatgtggtccttctggatcatgatagtgccatgcaggcatttcaccttgccttcgtaatcggtgcatccatgagcccacagagcgcacccggtgcactcccaattattgtgggcgatctcagaataagaatgcaccaatccctgcatgaatcttcccatcatcgctgtcagggtcttcatgctactaaatgtcagcggaatgccacggtgctcctcgttcacatactggtggcagatacgcttgtactgctcgtgctgctctggcatcagcttgaaagaggttctcaggtcattatccagcctatacctctccattagcacagccatcacttccatgcccttctcccaggcagataccaggggcaagctcaaaggattcctaacagcaatagaagtagctcctttagctatagggtcattcttgtcgatcttctcaacacttctcttgccatccttctcaatgatgcgcaccggggggtagctgaagcccacggccaccaactgagcctgttctctttcttcttcgctgtcctggctgatgtcttgcagagggacatgcttggtcttcctgggcttcttcttgggagggatcgggggaggactgttgctccgttccggagacagggatgaccgcgaagtttcgcttaccagtaccacctggctctcgatagaagaatcggaccccacgcgacggtaggtgttcctcttcgggggcagaggtggaggcgactgagatgggctgcggtctggccttggaggcggatggctggcagagcccattccgcgttcgggggtgtgctcccgttggcggtcgcttgactgatttcctccgcggctggccattgtgttctcctaggcagagaaacaacagacatggaaactcagccatcactgccaacatcgctgcaagcgccatcacacctcgcccccagcagcgacgaggaggagagcttaaccaccccaccacccagtcccgctaccaccacctctaccctcgatgatgaggaggaggtcgacgcagcccaggagatgcaggcgcaggataatgtgaaagcggaagagattgaggcagatgtcgagcaggacccgggctatgtgacaccggcggagcacgaggaggagctgaaacgttttctagacagagaggatgacgaccgcccagagcatcaagcagatggcgatcaccaggaggctggcctcggggatcatgttgccgactacctctccgggcgtgggggggaggacgtgctcctcaaacatctagcaaggcagtcgctcatagttaaagacgcactactcaacctcaccgaagtgcccatcagtgtggaagagcttagccgcgcctacgagctgaacctcttttcgcctcagataccccccaagcggcagccaaacggcacctgcgaggccaaccctcgactcaacttctatccagcttttactgtccccgaagtgctggccacctaccacatcttttttaagaaccaaaagattccagtctcctgccgcgccaaccgcacccgcgcagatgcccttctcaacttgggtccgggagctcgcttacctgatatagcttccttggaagaggttccaaagatctttgagggtctgggaagtgatgagactcgggccgcaaatgctctgcaacagggagagaatggcatggatgaacatcacagcgctctagtggaactggagggtgacaatgcccggcttgcagtgctcaagcgcagtatcgtggtcacccattttgcctaccccgctgttaacctgccgcccaaagtcatgagcgctgtcatggaccatctgctcatcaaacgagcaagtccactttcagaaaaccagaacatgcaggatccagacgcctcggacgagggcaagccggtagtcagtgacgagcagctatctcgctggctgggtaccaactccccccgagatttggaagaaagacgcaagcttatgatggctgtagtgctagtaactgttgagttggagtgtctgcgccgcttttttaccgaccccgagaccctgcgcaagctagaggagaacctgcactacaccttcagacatggcttcgtgcggcaggcatgcaagatctccaacgtggagctcaccaacctggtttcatacatgggcattttgcatgagaaccggctagggcagagcgttctgcacaccaccctgaagggggaggcccgccgcgactacatccgagactgtgtctacctctacctctgccatacctggcagactggtatgggtgtgtggcaacagtgtttggaagagcagaaccttaaagagctggacaagctcttgcagagatccctcaaagccctgtggacaggttttgacgagcgcaccgtcgcctcggacttggcggacatcatcttccccgagcgtcttacggttactctgcgaaacggcctgccagacttcatgagccagagcatgcttaacaactttcgctctttcatcctggaacgctccggtatcctgcctgccacctgctgtgcgctgccctccgactttgtgcctctcacctaccgcgagtgcccaccgccgctatggagccactgctacctattccgcctggccaactacctctcctaccactcggatgtgatagaggatgtgagcggagacggcctgctggaatgccactgccgatgcaatttatgcacaccccaccgctccctcgcctgcaacccccagttgctaagcgagacccagatcatcggcaccttcgagttgcagggtcccaacagtgaaggcgaggggtcttctccggggcagagtctgaaactgacaccggggctgtggacctccgcctacctgcgcaagtttcatcccgaggactatcatccctatgagatcaggttctatgaggaccagtcacatcctcccaaagtcgagctctcagcctgcgtcatcacccagggggcaattctggcccaattgcaagccatccaaaaatcccgccaagaatttctgctgaaaaagggaagcggggtctaccttgacccccagaccggtgaggagctcaacacaaggttcccccaggatgtcccatcgccgaggaagcaagaagctgaaggtgcagctgtcacccccagaggatatggaggaagactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggggcccagcggcggcccaacagtagatgggacgagaccgggcgattcccaaacccgaccaccgcttccaagaccggtaagaaggagcgacagggatacaagtcctggcgtggacataaaaacgctatcatctcctgcttgcatgaatgcgggggcaacatatccttcacccggcgatacctgcttttccaccacggtgtgaacttcccccgcaatatcttgcattactaccgtcacctccacagcccctactgcagtcagcaagtcccggcaaccccgacagaaaaagacagcagcgacaacggtgaccagaaaaccagcagttagaaaatccacaacaagtgcagcaggaggaggactgaggatcacagcgaacgagccagcgcagaccagagagctgaggaaccggatctttccaaccctctatgccatcttccagcagagtcgggggcaagagcaggaattaaaagtaaaaaaccgatctctgcgctcgctcaccagaagttgtttgtatcacaagagcgaagaccaacttcagcgcactctcgaggacgccgaggctctcttcaacaagtactgcgcgctgactcttaaagagtagcccttgcccgcgctcattcgaaaacggcgggaatcacgtcacccttggcagctgtcctttgccctcgtcatgagtaaagagattcccacgccttacatgtggagctatcagccccaaatggggttggcagcaggtgcttcccaggactactccacccgcatgaattggcttagcgccgggccctcaatgatatcacgggttaatgatatacgagcttatcgaaaccagttactcctagaacagtcagctctcaccaccacaccccgccaacaccttaatccccgaaattggcccgccgccctggtgtaccaggaaaatcccgctcccaccaccgtactacttcctcgagacgcccaggccgaagttcagatgactaacgcaggtgtacagctggcgggcggttccgccctatgtcgtcaccgacctcaacagagtataaaacgcctggtgatcagaggccgaggtatccagctcaacgacgagtcggttagctcttcgcttggtctgcgaccagacggagtcttccagatcgccggctgtgggagatcttccttcactcctcgtcaggctgtgctgactttggagagttcgtcctcgcagccccgctcgggcggcatcggaactctccagtttgtggaggagtttactccctctgtctacttcaaccccttctccggctctcctggccagtacccggacgagttcataccgaacttcgacgcaatcagcgagtcagtggatggctatgattgatgtctaatggtggcgcggctgagctagctcgactgcgacacctagaccactgccgccgctttcgctgtttcgcccgggaactcaccgagttcatctacttcgaactctccgaggagcaccctcagggtccggcccacggagtgcggattaccatcgaagggggaatagactctcgcctgcatcgcatcttctcccagcggcccgtgctgattgagcgcgaccagggaaatacaaccatctccatctactgcatttgtaaccaccccggattgcatgaaagcctttgctgtcttgtttgtgctgagtttaataaaaactgagttaagaccctcctacggactaccgcttcttcaatcaggactttacaacaccaaccagatcttccagaagacccagacccttcctcctctgatccaggactctaactctaccttaccagcaccctccactactaaccttcccgaaactaacaagcttggatctcatctgcaacaccgcctttcacgaagccttctttctgccaatactaccactcccaaaaccggaggtgagctccgcggtcttcctactgacgacccctgggtggtagcgggttttgtaacgttaggagtagttgcgggtgggcttgtgctaatcctttgctacctatacacaccttgctgtgcatatttagtcatattgtgctgttggtttaagaaatgggggccatactagtcgtgcttgctttactttcgcttttgggtctgggctctgctaatctcaatcctcttgatcacgatccatgtctagacttcgacccagaaaactgcacacttacttttgcacccgacacaagccgtctctgtggagttcttattaagtgcggatgggactgcaggtccgttgaaattacacataataacaaaacatggaacaataccttatccaccacatgggagccaggagttcccgagtggtatactgtctctgtccgaggtcctgacggttccattcgcattagtaacaacactttcattttttctgaaatgtgcgatctggccatgtttatgagcaaacagtatgacctatggcctcctagcaaagagaacattgtggcattttccattgcttattgcttggtaacatgcatcatcactgctatcatttgtgtgtgcatacacttgcttatagttattcgccctagacaaagcaatgaggaaaaagagaaaatgccttaacctttttcctcataccttttctttacagcatggcttctgttacagctctaattattgccagcattgtcactgtcgctcacgggcaaacaattgtccatattaccttaggacataatcacactcttgtagggcccccaattacttcagaggttatttggaccaaacttggaagtgttgattattttgatataatttgcaacaaaactaaaccaatatttgtaatctgcaacagacaaaatctcacgttaattaatgtcagcaaaatttataacggttactattatggttatgatagatccagtagtcaatataaaaattacttagttcgcataactcaacccaaatcaacagtgccaactatgacaataattaaaatggctaataaagcattagaaaattttacattaccaacaacgcccaatgaaaaaaacattccaaattcaatgattgcaattattgcggcggtggcattgggaatggcactaataataatatgcatgttcctatatgcttgttgctataaaaagtttaaacataaacaggatccactactaaattttaacatttaattttttatacagatgatttccactacaatttttatcattactagccttgcagctgtaacttatggccgttcacacctaactgtacctgttggctcaacatgtacactacaaggaccccaagaaggccatgtcacttggtggagaatatatgataatggagggttcgctagaccatgtgatcagcctggtacaaaattttcatgcaacggaagagacttgaccattattaacataacattaaatgagcaaggcttctattatggaaccaactataaaaatagtttagattacaacattattgtagtgccagccaccacttctgctccccgcaaatccactttctctagcagcagtgccaaagcaagcacaattcctaaaacagcttctgctatgttaaagcttcgaaaaatcgctttaagtaattccacagccgctcccaatacaattcctaaatcaacaattggcatcattactgccgtggtagtgggattaataattatatttttgtgcataatgtactacgcctgctgctatagaaaacatgaacaaaaaggtgatgcattactaaattttgatatttaattttttatagaattatgatattgtttcaatcaaataccactaacactatcaatgtgcagactactttaaatcatgacatggaaaaccacactacctcctatgcatacacaaacattcagcctaaatacgctatgcaactaagaaatcaccatactaattgtaattggaattcttatactatctgttattctttattttatattctgccgtcaaatacccaatgttcatagaaattctaaaagacgacccatctattctcctatgattagtcgtccccatatggctctgaatgaaatctaagatctttttttttctcttacagtatggtgaacatcaatcatgattcctagaaatttcttcttcaccatactcatctgtgctttcaatgtctgtgctactttcacagcagtagccactgcaagcccagactgtataggaccatttgcttcctatgcactttttgccttcgttacttgcatctgcgtgtgtagcatagtctgcctggttattaattttttccaactggtagactggatctttgtgcgaattgcctacctacgtcaccatcccgaataccgcaatcaaaatgttgcggcactttttaggcttatttaaaaccatgcaggctatgctgccagtcattttaattctgctcctaccctgcattgccctagcttccaccgccactcgcgctacacctgaacaacttagaaaatgcaaatttcaacaaccatggtcatttcttgattgctaccatgaaaaatctgattttcccacatactggatagtgattgttggaataattaacatactttcatgtacctttttctcaatcacaatataccccacatttaattttgggtggaattctcccaatgcactgggttacccacaagaaccacatgaacatatcccactacaacacatacaacaaccactagcactggtagagtatgaaaatgagccacaaccttcactgcctcctgccattagttacttcaacctaaccggcggagatgactgaaatactcaccacctccaattccgccgaggatctgcttgatatggacggccgcgcctcagaacagcgactcgcccaactacgcatacgccagcagcaggaacgtgccgccaaggagctcagggatgctattgaaattcaccaatgcaaaaaaggcatattttgtttggtaaaacaagccaagatatcctacgagattaccaatactgaccatcgcctctcatacgagctcggaccgcagcgacaaaaattcacttgtatggtgggaatcaaccccataatcatcacccagcaagctggagataccaagggttgcatccactgttcctgcagttccgccgagtgcatctacaccctgctgaagaccctctgcggccttcgagacctcctacccatgaactaatcaacccagcccctcacttaccaattacataaagccaattaataaaaacacttacttgaaatcagaaataaggtttctgtctacgttgtttccaagcagcacctcacttccttcttcccaactctggtactctaagcctcggcgggtggcatacttcctccacactttgaaagggatgtcaaattttagttcctcttctttgcccacaatcttcatttctttatccccagatggccaaacgagctcggctaagcagctccttcaatccggtctacccctatgaagatgaaagcagctcacaacacccctttataaaccctggtttcatttcctcaaatggttttgcacaaagcccagatggagttctaactcttaaatgtgttaatccactcactaccgccagcggacccctccaacttaaagttggaagcagtcttacagtagatactatcgatgggtctttggaggaaaatataactgccgcagcgccactcactaaaactaaccactccataggtttattaataggatctggcttgcaaacaaaggatgataaactttgtttatcgctgggagatgggttggtaacaaaggatgataaactatgtttatcgctgggagatgggttaataacaaaaaatgatgtactatgtgccaaactaggacatggccttgtgtttgactcttccaatgctatcaccatagaaaacaacaccttgtggacaggcgcaaaaccaagcgccaactgtgtaattaaagagggagaagattccccagactgtaagctcactttagttctagtgaagaatggaggactgataaatggatacataacattaatgggagcctcagaatatactaacaccttgtttaaaaacaatcaagttacaatcgatgtaaacctcgcatttgataatactggccaaattattacttacctatcatcccttaaaagtaacctgaactttaaagacaaccaaaacatggctactggaaccataaccagtgccaaaggcttcatgcccagcaccaccgcctatccatttataacatacgccactgagaccctaaatgaagattacatttatggagagtgttactacaaatctaccaatggaactctctttccactaaaagttactgtcacactaaacagacgtatgttagcttctggaatggcctatgctatgaatttttcatggtctctaaatgcagaggaagccccggaaactaccgaagtcactctcattacctcccccttctttttttcttatatcagagaagatgactgacaacaaaaaaaataaagatcaacttttttattgaaaatcagtttacaagattcgagtagttattttgcccccctcttcccattttatagaatacacaattctctccccacgcacagctttgaacatttgaattccattagagatagacatagttttagattccacattccacacagtttcagagcgggccaatcttggatcagtgatagatataaatccatcggaacagtctttcaaggtggtttcacagtccaactgctgcggctgcggctccggggtttggattagggtcatctggaagaagaacgatgggagtcataatccgagaacgggatcgggcggttgtgtcttaaacctcgaagcaatcgctgtctgcgccgctccgtgcgactgctgctgatgggatcaggatccacagtctctcgaagcataattttaatagccctcaacattaacatcctggtgcgatgggcacaacaacgcattctaatttcgcttagctcactgcagtaggtacaacacattaccacaatgttgtttaacaggccataattaaaggtgctccagccaaaactcatctcagggataatcatacccgcgtgaccatcgtaccaaatcttaatgtaaattagatgacgccccctccagaacacactgcccacatacataatttccttgggcatatgcatgttcacaatttctctgtaccatggacagcgctggttaatcatacagcccctaataaccttccggaaccacatagctagcactgctcccccagcaatacattgaagagaacccggctgtttacagtgacaatggagaacccacttctctcgcccatggatcacttgagaattaaatatatctatagtggcacaacacaaacataaatgcatgcatcttttcataaccctcaactcttcgggggttaaaaacatatcccagggaataggaagctcttgcaaaacagtaaagctggcagaacaaggaagaccacgaacacaacttacactatgcatagtcatagtatcacaatctggcaacagcgggtggtcttcagtcatagaagctcgggtttcattttcctcacatcgtggtaactgggctctggtgtaagggtgatgtctggcgcatgatgtcgagcgtgcgcgcaaccttgtcataatggagttgcttcctgacattctcgtattttgtatagcaaaatgcggccctggcacaacacacttttcttcgtcttctatcctgccgcttagtgtgttccgtctgataattcaagtacagccacactcttaagttggtcaaaagaatgctggcttcagttgtaatcaaaactccatcatatttaattgttctaaggaaatcatccacggtagcatatgcaaatcccaaccaagcaatgcaactggattgcgtttcaagcagcagaggagagggaagagacggaagaatcatgttaatttttattccaaacgatctcgcagtacttcaaattgtagatcgcgcagatggcatctatcgcccccactgtgttggtgaaaaagcacagctaaatcaaaagaaatgcgattttcaaggtgctcaacggtggcttccaacaaagcctccacgcgcacatccaaaaacaaaagaataccaaaagaaggagcattttctaactcctcaaacatcatattacattcctgcaccattcccagataattttcagctttccagccttgaattattcgtgtcagttcttgtggtaaatccaaaccacacattacaaacaggtcccggagggcgccctccaccaccattcttaaacacaccctcataatgacaaaatatcttgctcctgtgtcacctgtagcaaattaagaatggcatcatcaattgacatgcccttggctctaagttcttctctaagttctagttgtaaatactctctcatattatcaccaaactgcttagccagaagccccccgggaacaatagcaggggacgctacagtgcagtacaagcgcagacctccccaattggctccagcaaaaacaagattagaataagcatactgggaaccaccagtaatatcatcaaagttgctggaaatataatcaggcagagtttcttgtaaaaattgaataaaagaaaaattttccaaagaaacattcaaaacctctgggatgcaaatgcaataggttaccgcgctgcgctccaacattgttagttttgaattagtctgtaaaataaaagaaacaagcgtcatatcatagtagcctgtcgaacaggtggataaatcagtctttccatcacaagacaagccacagggtctccagcttgaccctcgtaaaacctgtcatcgtgattaaacaacagcaccgaaagttcctcgcggtggccagcatgaataattcttgatgaagcatataatccagacatgttagcatcagttaaagagaaaaaacagccaacatagcctctgggtataattatgcttaatcttaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcgcacaaagcacaagctctaaagaagctctaaagacactctccaacctctccacaatatatacacaagccctaaactgacgtaatgggagtaaagtgtaaaaaatcccgccaagcccaacacacaccccgaaactgcgtcagcagggaaaagtacagtttcacttccgcaaacccaacaagcgtaacttcctctttctcacggtacgtcacatccgattaacttgcaacgtcattttcccacggccgcaccgccccttttagccgttcaccccgcagccaatcaccacacagcgcgcacttttttaaattacctcatttacatgttggcaccattccatctataaggtatattattgataatg

SEQ ID NO: 586 - DNA, 36001 bp, ATCC#VR-1, strain Adenoid 71 1953
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggtaaaagtgacgtttttggtgtgcgccggtgtacacgggaagtgacaattttcgcgcggttttaggcggatgttgtagtaaatttgggcgtaaccgagtaagatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaaatgagacatattatttgccacggaggtgttattaccgaagaaatggccgccagtcttttggaccagctaatcgaagaggtactggctgataatcttccacctcctagccattttgaaccacctacccttcacgaactgtatgatttagacgtgacggcccccgaagatcccaacgaggaggcggtttcgcagatttttcctgactctgtaatgttggcggcgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcagcccgggcacggttgcaggtcttgtcattatcatcggaggaatacgggggacccagatattatgtgttcgctttgctatatgaggacctgtggcatgtttgtctacagtaagtgaaattatgggcagtgggtgatagagtggtgggttcggtgtggtaattttttttttaattttttgcagttttgtggtttaaagaattttgtattgtgattttttttaaaaggtcctgtgtctgaacctgagcctgagcccgagccagaaccggaacctgcaagacctgcccggcgtcctaaaatggtgcctgctatcctgagacgcccgacatcacctgtgtccagagaatgcaatagtagtacggatagctgtgactccggtccttctaacacacctcctgagatacatccggtggtcccgctgtgccccattaaaccagttgccgtgagagttggtgggcgtcgccgggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaaaagggtgagataatgtttaacttgcatggcgtgttaaatggggcggggcttaaagggtatataatgcgccgtgggctaatcttggttacatttgacctcatggaggcttgggagtgtttggaagatttttctgctgtgcgtaacttgctggaacagagctctaacagtacctcctggttttggaggtttctgtggggctcctcccaagcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatttgtggagagcggtggtgagacacaagaatcgcctactactgttgtcttccgtccgcccggcaataataccgacggaggagcagcagcagcaacagcagcagcaggaggaagccaggcggcggcggcggcaggagcagagcccatggaacccgagagccggcctggaccctcgggaatgaatgttgtacaggtggctgaactgtttccagaactgagacgcattttaacaattaacgaggatgggcaggggctaaagggggtaaagagggagcggggggcttttgaggctacagaggaggttaggaatttaacttttagcttaatgaccagacaccgtcctgagtgtgttacttttcagcagattaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagattagcaaacttgtaaatattaggaattgttgctacatttctgggaacggggccgaggtggagatagatacggaggatagggtggcctttagatgtagcatgataaatatgtggccgggggtacttggcatggacggggtggttattatgaatgtgaggtttactggccccaattttagcggtacggttttcctggccaataccaaccttatcctacacggtgtaagcttctatgggtttaacaatacctgcgtggaagcctggaccgatgtaagggttcgaggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtgtgtggcaactgcgaggacagggcctctcagatgctaacctgctcggacggcaactgtcacctgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgaaagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtctcatgtagttttgtatctgttttgcagcagccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggagctgcgccagcaggtttctgccctgaaggcttcctcccctcccaatgcggtttaaaacataaataaaaaccagactctgtttggatttggatcaagcaagtgtattgctgtctttatttaggggttttgcgcgcgcggtaggcccgggaccagcggtctcggtcgttgagggtcctgtgtattttttccaggacgtggtagagatggctctggatgttcagatacatgggcataagcccgtctctggggtggaggtagcaccactgcagagcttcatgctgcggggtggtgttgtagatgatccagtcgtagcaggagcgctgggcgtggtgcctaaaaatgtcctttagaagcaagctgattgccaggggcaggcccttggtgtaagtgtttacaaagcggttaagctgggatgggtgcatacgtggggatatgagatgcatcttggactgtatttttaggttggctatgttcccagccatatccctcctgggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcaataaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaagggggccacttcgttaagcatgtccctgacacgcatgttttccctgaccaaatccgctagaaggcgctcgccgcccagcgatagcagttcttgcaaggaagcaaagtttttcaacggtttgaggccgtccgccgtaggcatgcttttgagcgtttgaccaagcagttccaggcggtcccacagctcggtcacgtgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcatggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacgaaggctcgcgtccaggccagcacgaaggaggctaagtgggaggggtagcggtcgttgtccactagggggtccactcgctccagggtgtgaagacacatgtccccctcttcggcatcaaggaaggtgattggtttataggtgtatgccacgtgaccgggtgttcctgaagggggggtataaaagggggtgggggcgcgttcgtcctcactctcttccgcatcgctgtctgcgagggccagctgttggggtgagtactccctctggaaagcgggcatgacttctgcgctaaggttgtcagtttccaaaaacgaggaggatttgatattcacctggcccgcggtgatgcctttgagggtggccgcgtccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtccgcgtccacggtaaagatcccgggcaacaggcgcgcgtcgaagtagtctatcttgcatccttgcaagtctaacgcctgctgccatgcgcgggcggcaagcgcgcgctcgtatgggttgagtgggggaccccatggcatggggtgggtgagcgcggaggcgtacatgccgcagatgtcgtaaacgtagaggggctccctgagtattccaagatatgtagggtagcatcttccaccgcggatgctggcgcgcacgtaatcgtatagttcgtgcgagggggcgaggagttcgggaccgaggttgctacgggcgggctgctctgctcggaagacgatctgcctgaagatggcatgcgagttcgatgatatggttggacgctggaagacgttgaagctggcgtctgtaagacctaccgcatcacgcacgaaggaggcgtaggagtcgcgcagcttgttgaccagctcggcggtgacctgcacgtctagggcacagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcgggtttggtagggcgaaggtgacatcgttgaagagtatctttcccgcgcgaggcataaaattgcgtgtgatgcggaagggtcccggcacctcggaacggttgttaattacctgggcggcgagcacgatctcgtcaaagccgttgatgttgtggcccacgatgtaaagttccaagaagcgcggggtgcccttaatggagggcaattttttaagttcttcgtaggtaagctcttcaggggagttgagcccgtgctctgacagggcccagtctgcaagatgagggttggaagcaacgaatgagctccacaggtcacgggccattagcatttgcagatggtcgcgaaaggtcctaaactggcgacctacggccattttttctggggtgatgcagtagaaggtaagcgggtcttgttcccagcggtcccatccaaggtccacggctaggtctcgcgcggcggtcactagaggctcatctccgccgaatttcatgaccagcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcaaatgggagctgtccatggtctggagctcccgcggcgtcaggtcaggcgggagctcctgcaggtttacctcgcatagccgggtcagggcgcgggctaggtccaggtgatacctgatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgggcccccggaggtagggggggctcgggacccgccgggagagggggcaggggcacgtcggcgccgcgcgcgggcaggagctggtgctgcgcacggaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggagatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccgtgcggcagggatacggcgctaacgatgcatctcaacaattgttgtgtaggtactccgccaccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcattggctgaagcagggccaggtcggcgacaacgcgctcggctaatatggcctgctgcacctgcgtgagggtagactggaagtcatccatgtcaacaaagcggtggtatgcgcccgtgttgatggtgtaagtgcagttggccataacggaccagttaacggtctggtggcccggctgcgagagctcggtgtatctgagacgcgagtaagcccttgagtcaaagacgtagtcgttgcaagtccgcacgaggtactggtatcctaccaaaaagtgcggcggcggctggcggtagaggggccagcgtagggtggccggggctccgggggcgaggtcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcagtcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagcgctccttttggcttccttccaggcgcggcggctgctgcgctagctttttttggccactggccgcgcgcggcgtaagcggttaggctggaaagcgaaagcattaagtggctcgctccctgtagccggagggttattttccaagggttgagtcgcgggacccccggttcgagtctcgggccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctccccttctcctaccgcgtcaggaggggcaacatccgcggctgacgcggcggcagatggtgattacgaacccccgcggcgccgggcccggcactacctggacttggaggagggcgagggcctggcgcggctaggagcgccctctcctgagcgacacccaagggtgcagctgaagcgtgacacgcgcgaggcgtacgtgccgcggcagaacctgtttcgtgaccgcgagggagaggagcccgaggagatgcgggatcgaaagttccatgcagggcgcgagttgcggcatggcctgaaccgcgagcggttgctgcgcgaggaggactttgagcccgacgcgcggaccgggattagtcccgcgcgcgcacacgtggcggccgccgacctggtaaccgcgtacgagcagacggtgaaccaggagattaactttcaaaaaagctttaacaaccacgtgcgcacgcttgtagcgcgcgaggaggtggctataggactgatgcatctgtgggactttgtaagcgcgctggagcaaaacccaaatagcaagccgctcatggcgcagttgtttcttatagtgcagcacagcagggacaacgaggcattcagggatgcgctgttaaacatagtagagcccgagggccgctggctgctcgatttgataaatattctgcagagcatagtggtgcaggagcgcagcttgagcctggctgacaaggtggccgccattaactattccatgctcagtctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatatttctgatcagatgatgcaagacgcaacggacccggcggtgcgggcggcgctgcagagccagccgtccggccttaactccacggacgactggcgccaggtcatggaccgcatcatgtcgctgactgcgcgcaaccctgacgcgttccggcagcagccacaggccaaccggctctccgcaattctggaagcggtggtcccggcgcgcgcaaaccccacgcacgagaaggtgctggcgatcgtaaacgcgctggccgaaaacagggccatccggcccgatgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtccgggccagactattttttccagaccagtagacaaggcctgcagaccgtaaacctgagccaggctttcaagaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgagaggccataggtcaggcgcatgtggacgagcatactttccaggagattacaagtgttagccgcgcgctggggcaggaggacacgggcagcctggaggcaaccctgaactacctgctgaccaaccggcggcagaagatcccctcgttgcacagtttaaacagcgaggaggagcgcattttgcgctatgtgcagcagagcgtgagccttaacctgatgcgcgacggggtaacgcccagcgtggcgctggacatgaccgcgcgcaacatggaaccgggcatgtatgcctcaaaccggccgtttatcaatcgcctaatggactacttgcatcgcgcggccgccgtgaaccccgagtatttcaccaatgccatcttgaacccgcactggctaccgccccctggtttctacaccgggggatttgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctaggcgaggaggagtacctaaacaactcgttgctgcagccgcagcgcgaaaagaacctgcctccggcgtttcccaacaacgggatagagagcctagtggacaagatgagtagatggaagacgtatgcgcaggagcacagggatgtgcccggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagcgtggtgagcgcggcgccagtggcggcggcgctgggttcccccttcgatgctcccctggacccgccgttcgtgcctccgcggtacctgcggcctaccggggggagaaacagcatccgttactctgagttggcacccctattcgacaccacccgtgtgtaccttgtggacaacaagtcaacggatgtggcatccctgaactaccagaacgaccacagcaactttctaaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgctcgcttactaaggacaaacaggtggagctgaaatatgagtgggtggagttcacgctgcccgagggcaactactccgagacaatgaccatagaccttatgaacaacgcgatcgtggagcactacttgaaagtgggcaggcagaacggggttctggaaagcgacatcggggtaaagtttgacacccgcaacttcagactggggtttgacccagtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgacctggagggtggtaacattcccgcactgttggatgtggacgcctaccaggcaagcttgaaagatgacaccgaacagggcgggggtggcgcaggcggcggcaacaacagtggcagcggcgcggaagagaactccaacgcggcagccgcggcaatgcagccggtggaggacatgaacgatcatgccattcgcggcgacacctttgccacacgggcggaggagaagcgcgctgaggccgaggcagcggccgaagctgccgcccccgctgcggaggctgcacaacccgaggtcgagaagcctcagaagaaaccggtgattaaacccctgacagaggacagcaagaaacgcagttacaacctaataagtaatgacagcaccttcacccagtaccgcagctggtaccttgcatacaactacggcgaccctcaggccgggatccgctcatggaccctgctttgcactcctgacgtaacctgcggctcggagcaggtatactggtcgttgcccgacatgatgcaagaccccgtgaccttccgctccacgagccagatcagcaactttccggtggtgggcgccgagctgttgcccgtgcactccaagagcttctacaacgaccaggccgtctactcccagctcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgtttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccgccagtgtccaccgtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgagccgctcgaaggctggccgcgggtattgtcactgtgccccccaggtccaggcgacgagcggccgccgcagcagccgcggccattagtgctatgactcagggtcgcaggggcaacgtgtactgggtgcgcgactcggttagcggcctgcgcgtgcccgtgcgcacccgccccccgcgcaactagattgcaataaaaaactacttagactcgtactgttgtatgtatccagcggcggcggcgcgcatcgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgttgcacgcgaccgcgcccaggcggcgggtacagtggaaaggtcgacgcgtaagacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtgacactgcagcaggtgctgcccgcgcttgcaccgtccgaagaaaagcgcggcctaaagcgcgagtctggtgacttggcgcccaccgtgcagctcatggtgcccaagcgccaacgactggaagatgtcttggaaaaaatgaccgtggagcctgggctggagcccgaggtccgcgtgcgaccaatcaagcaggtggcaccgggactgggcgtgcagaccgtggacgttcagatacccaccaccagtagcactagtattgccactgccacagagggcatggagacacaaacgtccccggtcgcctcggcggtggcagatgccgcggtgcaggcggccgctgcggccgcgtccaaaacctctacggaggtgcaaacggacccgtggatgtttcgcgtttcagccccccggcgtccgcgccgttcgaggaagtacggcgccgccagcgcgctactgcccgaatatgccctacatccttccatcgcgcctacccccggctatcgtggctacacctaccgccccagaagacgagcaactacccgacgccgaatcaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccaaatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgttgccagatgggcgtggcgaaaagcgcccgcgccccgacagggaagagactctggtgacacaaatcgacgagcctccctcgtacgaggaggcgctaaagcaaggcctgcccaccacccgtcccatcgcgcccatggctaccggagtgttgggccagcacacacctgtaacgctggacctgcctccccccgctgacacccagcagaaacctgtgctgccagggccgtccgccgttgttgtaacccgccctagccgcgcgtccctgcgccgtgccgccagcggtccgcgatcgttgcggcccgtagccagtggcaactggcaaagcacactgaacagcatcgtgggtctgggggtgcaatccctaaagcgccgacgatgcttttgaatagctaacgtgtcgtatgtgtgtcatgtatgcgtccatgtcgccgccagaggagctgctgagtcgccgcgcgcccgctttccaagatggctaccccttcgatgatgccgcagtggtcttacatgcacatctcgggccaggacgcctcggagtacctgagccccgggctggtgcagttcgcccgcgccaccgagacgtacttcagcctgaataacaagtttagaaaccccacggtggcgcctacgcacgacgtgaccacagaccggtctcagcgtttgacgctgcggtttatccccgtggaccgcgaggataccgcatactcgtacaaggcgcggtttaccctggctgtgggtgacaaccgtgtgcttgacatggcttccacatactttgacattcgcggcgtgctggaccggggccccacttttaagccctactccggcactgcctacaacgctctagcccccaaaggcgctcccaattcctgcgagtgggaacaagaagaaccaactcaggaaatggctgaagaacttgaagatgaggaggaggcagaggaggaggaggcagaggaggaggcagaagcaccacaagctgatcagaaggttaagaagactcatgtatatgctcaggctcctttggcaggggaaaaaattaccgccaatggcttacaaatagtttctgatacccaaactgaaggcaatccagtttttgccgatcccacttatcaacctgaacctcaggttggagaatctcagtggaatgaagctgaagcaactgcatctggaggcagagtactaaaaaagactactcccatgaaaccatgctacggatcgtatgccagacctacaaataaaaatgggggtcaaggtatactagtagcaaacaaccaaggtgctctagagtctaaagttgaaatgcagttttttgccccctctggcactgccatgaatgaaagaaatgctgttcagccaagtattgttttgtacagtgaggatgttaatatggaaactcctgatactcacatttcatacaaaccaagcaaaactgatgaaaactctaaggctatgttgggtcaacaagcaatgccaaacagacccaattacatcgcttttagggacaattttattggccttatgtattacaacagcactggtaacatgggtgtccttgctggacaagcatcacagctaaatgccgtggtagacttgcaggacagaaacacagagctgtcatatcaacttttgcttgattctattggcgatagaaccagatacttttccatgtggaatcaggctgtagacagctatgatccagatgtcagaatcattgaaaatcatggaactgaggatgagttgccaaattactgcttcccacttggcggtataggggtaactgacacctaccaaggtataaaatcaaacggaaacggtaatcctcaaaactggaccaaaaatgacgattttgcggcacgtaatgaaataggtgtgggaaacaactttgccctggagattaaccttaatgccaacctatggagaaatttcctctactccaacattgcactgtacctgcctgacaagctaaaatacactcctacaaatgtggaaatatctcccaaccctaattcatacgattatatgaacaagcgagtggtggctcccgggttggtggattgctacattaaccttggagcgcgttggtcattggactacatggacaacgtcaacccctttaaccatcaccgcaatgcgggcctacgctaccgctccatgttgctgggcaacggtcgctacgtgccctttcacatccaggttcctcagaagttttttgccattaagaacctcctactcttgccgggctcatacacctacgagtggaacttcaggaaagatgttaacatggtcctgcaaagctccctaggaaacgacctaagagttgacggagccagcattaagtttgacagcatttgcctctacgccaccttttttccgatggcccacaacaccgcctcaacgcttgaagccatgcttagaaacgacaccaacgaccagtcctttaacgactacctatccgccgccaacatgctttaccccatacccgccaacgccaccaacgtgcccatctctatcccctcgcgcaactgggcggctttccgaggctgggcctttacgcgccttaagactaaggaaaccccatccctgggttccggctacgacccttactatacctactctggctccataccctacctagacggaaccttttaccttaatcacaccttcaaaaaggtagccatcacctttgactcttctgttagctggcctggcaatgaccgtctgcttacccccaacgagtttgagatcaagcgttcagttgacggagagggctacaacgttgcccaatgcaacatgaccaaagactggttcttggtacagatgctagccaactacaacataggctaccagggcttttatatcccagaaagctataaggaccgcatgtactccttctttagaaacttccagcccatgagccgtcaggtggtggacgataccaaatacaaggactaccaacaggtgggcatcctccaccagcacaataactctggctttgttggttacctcgctcccaccatgcgagagggacaggcctaccccgccaacttcccctacccgcttataggcaagaccgcggttgacagtattacccagaaaaagtttctttgcgaccgcaccctttggcgcattccattctccagtaactttatgtccatgggtgcactcacagacctgggccaaaaccttctctatgcaaactccgcccacgcgctagatatgacttttgaggtggatcccatggacgagcccacccttctttatgttttgtttgaagtctttgacgtggtccgtgtgcaccagccgcaccgcggcgtcatcgagaccgtgtacctgcgcacgcccttctcggctggcaacgccacaacataaagaagcaagcaacatcaacaacagctgccgccatgggctccagtgagcaggaactaaaagccattgtcaaagatcttggttgtggaccatattttttgggcacctatgacaagcgcttcccaggctttgtttccccacacaagctcgcctgcgccatagttaacacggccggtcgcgagactgggggtgtacactggatggcctttgcctggaacccgcgctcaaaaacatgctacctctttgagccctttggcttttctgaccaacgtctcaagcaggtttaccagtttgagtacgagtcactcctgcgccgtagcgccattgcctcttcccccgaccgctgtataacgctggaaaagtccacccaaagcgtgcaggggcccaactcggccgcctgtggcctattctgctgcatgtttctccacgcctttgccaactggccccaaactcccatggatcacaaccccaccatgaaccttattacaggggtacccaactccatgcttaacagtccccaggtacagcccaccctgcgccgcaaccaggaacagctctacagcttcctggagcgccactcgccctacttccgcagccacagtgcgcaaattaggagcgccacttctttttgtcacttgaaaaacatgtaaaaataatgtactaggagacactttcaataaaggcaaatgtttttatttgtacactcttgggtgattatttaccccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggccccgatatcttgaagtcgcagttggggcctccgccctgcgcgcgcgagttgcgatacacagggttgcagcactggaacactatcagcgccgggtgatgcacgctggccagcacgctcttgtcggagatcagatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccggtctgggcgttaggatacagcgccttcataaaggcctggatctgcttaaaagccacctgggcctttgcgccttcggaaaaaaacatgccgcaagacttgccggaaaactgattcgccggacaggccgcgtcgtgcacgcagcacctcgcgtcggtgttggagatctgtaccacgcttcggccccaacggttcttcacaatcttggccttgctagactgctccttcagcgcgcgctgcccgttttcgctcgtcacatccatttcaatcacgtgctccttgtttatcataatgctcccgtgtagacacttaagctcgccttcgatctcagcgcagcggtgcagccacaacgcgcagcccgtgggctcgtggtgcttgtaggtcacctctgcaaacgactgcaggtacgcttgcaggaatcgccccatcatcgtcacaaaggtcttgttgctggtaaaggtcagctgcaacccgcggtgctcctcgttcagccaggtcttacatacggccgccagggcttccacttggtcaggcagtagcttgaagttcgcctttagatcgttatccacgtgatacttgtccatcagcgcgcgcgcagcctccatgcccttctcccacgcagacacgatcggcagactcagcgggttcattaccgtgctttcactttccgcttcgctgggctcttcctcttcctcttgcatccgcataccccgcgccactgggtcgtcttcattcagccgccgcaccgtgcgcttacctcccttgccgtgcttaattagcaccggtgggttgctgaaacccaccatttgtagcgccacatcttctctttcttcctcgctgtccacaatcacctctggggatggcgggcgctcgggcttgggagatgggcgcttctttttcttcttgggcgcgttggccaaatccgccgccgaggttgatggccgcgggctgggtgtgcgcggcaccagcgcgtcttgtgacgagtcttcttcgtcctcggactcgagacgccgcctcagccgcttttttgggggcgcgcggggaggcggcggcgacggcgacggggacgacacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctctgagttcgccaccaccgcctccaccgatgccgccaacgcgcctaccaccttccccgtcgaggcacccccgcttgaggaggaggaagtgactatcgagcaggacccaggttttgtaagcgaagacgacgaggaccgctcagtaccaacagaggataaaaagcaagaccaggacgacgcagaggcaaacaaggagcaagtcgggcggggggacgagaggcatggcgactacctagatgtgggagacgacgtgctgttgaagcatctgcagcgccagtgcgctattatctgcgacgcgttgcaagagcgcagcgatgtgcccctcgccatagcggatgttagccttgcctacgaacgccacctgttctcaccgcgtgtaccccccaaacgacaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaagcgcgcggcaaacgctctgcaacaagaaaacagcgaaaatgaaagtcattgtggagtgctggtggaacttgagggtgacaacgcgcgcctagccgtgctaaaacgcagcatcgaggtcacccactttgcctacccggcacttaacctaccccccaaggttatgagcacagtcatgagcgagctgattgtgcgccgtgcacaacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttactgacccgaagatgcagcgcaagctagaggaaacattgcactacacctttcgccagggctacgtgcgccaggcctgcaaaatttccaacgtggagctctgcaacctggtctcctaccttggaattttgcacgaaaaccgcctcgggcaaaacgtgcttcattccacgctcaagggcgaggcgcgccgcgactacgtccgcgactgcgtttacttatttctatgctacacctggcaaacggccatgggcgtgtggcagcagtgcctggaggagcgcaacctgaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaatcctgcccgccacctgctgtgcgcttcctagcgactttgtgcccattaagtaccgtgaatgccctccgccgctttggggtcactgctaccttctgcagctagccaactaccttgcctaccactccgacatcatggaagacgtgagcggtgacggcctactggagtgtcactgtcgctgcaacctatgcaccccgcaccgctccctggtctgcaattcgcagctgcttagcgagagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgcccaatgcggagcttaccgcctgcgtcattacccagggccacatccttggccaattgcaagccatcaacaaagcccgccaagagtttctgctacgaaagggacggggggtttacttggacccccagtccggcgaggagctcaacccaattcccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggccgaagaggtgtcagacgaaacaccgtcaccctcggtcgcattcccctcgccggcgccccagaaatcggcaaccggtccaagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcgtggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctaaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccactatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctcgcttggtctccgtccggacgggacatttcagatcggcggtgccggccgctcttcatttacgccccgtcaggcgatcttaactctgcaaacctcatcctcggagccgcgctccggaggcattggaactctacaatttattgaggagttcgtgccttcggtttacttcaaccccttttctggacctcctggccactacccggaccagtttattcccaactttgacgcggtgaaggactcggcggacggctacgactgaatgactagtggagaggcagagcaactgcgcctaacacaccttgaccactgccgccgccacaagtgctttgcccgcggctccggtgagttttgttactttgagttgcccgaagagcatatcgagggcccggcgcacggcgtccggctcaccacccaggtagagcttactcgtagcctaattcgggagtttaccctgcgccccctgctagtggagcgggagaggggtccctgtgttctgaccgtggtttgcaactgtcctaaccctggattacatcaagatctttgttgccatctctgtactgagtataataaatacagaaattagaatctactggggctcctgtcgctcctgtaaacgccaccgtcttcacccacccaaacctgcgatttgcacaggcgggccaaaaagtaccttgccggtacttaacggctcttcctttgtgatttacaacagtttcaaccaagacggagtgagccgcggacaacctctccgggcttatcagaaaaaatcaccctccttacctgccgggaacgtaccagtgcgtcaccggtcgccgcacccaccgcctgattgttaaccaacatttccagcaacagacctcaataattcccattttccataagaggaggtgagcttaaccccctggaagcgcatttttactgtttttaggcaaggtgtatgaactctactaactctacgggcttctctgcttcaggtaatttttctggaatcgggctcggggtcattctcactcttgtaattctctttatttttatactagcgcttctgtgtcttaggcttgccgcctgctgcgcacacgtttgcatttactgtcagcttattaaacgctggggacgccacccaagatgattaaatacatcattttaagcttgcttaccctagcggcagtctgcagtgctgccaaacaggtagagtttaaggagccagcttgcaatgttacatttaaatccgaagctaatgaatgcaccactcttataaaatgcaccacagaacatgaaaagcttattattcgccacaaagacaaagctggcaagtatgctgtatatgctatttggcagcctggagaccctaacaactataatgttacagtttttcagggtaatgattctaaagtttttttgtatgaatttccattttatgaaatgtgtgacattaccatgtacatgagcaaacagtataagttgtggcccccacaaaagtgtgtggagaacactggcactttttgctttactgctctcctgattacagtgattactttggtgtgtaccctcctttatattaaatttaaaagcagacgcagctttattgaagaaaagaaaatgccttagcatgctgccgccgcttcttgcttgcattgcaaaacagcttacaaccttagcattataatagcatgtcttgcaacgcccccctcaaagctccccactttaccctgcttaatgtcattcccatggacaatggactctgtggaatatgtgccaggttggcaaggcaagacacacgcctacaaccttaaagtcaggctttcctggactgagagcgcctgacttcaacagcacctgccccgtggagttcatccagcaacttcagcagcccgccttcgacatggtcgacacagtgaactcttacaacaccgctaccggactcacatctacccaagatatgccccaagtttctacctttgttaataattgggcaaacttgggcatgtggtggttttcaatagcgcttatgtttgtctgccttattattatgtggctttcctgctgcctaaagcgcaaacgcgcccgaccacccatttataagcccattattgtgcttaacccaaacaatgatggaatacatagattggacgggctgaacacttgttctttttcttttgcagtatgattaaatgagacatgattcctcgagtttttatattattgacccttattgcgcttttctgcgcgtgctccacattggccgcggttgctaacatcgaagtagactgcattccagccttcacagtctacctgctttacggatttgtcacccttacgctcatctgcagcctcatcactgtagtgatcgcctttattcaatgcattgactgggtctgtgtgcgcattgcataccttagacaccatcctcaatacagagacacggccatagctgagcttcttagaattctttaattatgaaaattacttggattttcttactaattttttacaccttaactgtggtttgctcccagacctccaagcctccccaaagacatgtatcttgcagatttactcgtatatggaacattccaagttgctacactgaaaaaagcgacctgtccgaaacctggttgtatgccatcatctcggtttttgtattttgtagcaccataattgcactagccatatacccctacctggatattggatggaacgccatagacgccatgagccattccactttccccgcgcccgctataattcagatgcagccaattgttgccggcggcattgtcccagccaatcagcatcgccctccttctcccactcccactgagattagctactttaatctaacaggcggagatgactgacggcctagatctagaaatggacggaattattaccgagcagcgtctgctacagaggcgcaaagcagcggcagagcaggaacgcctaaatcaggagctccaagacatggttaacctgcaccagtgtaaaagaggtattttttgtctggttaagcaggcaaaagttacctacgagaaggaccacagcaaccaccgccttagctacaagctgcccgccaagcgccaaaaactgctgcttatggtgggagaaaggcccatcaccgtcactcagcagtcagtagaaactgagggctgtctgcacttcccctgccagggtccagaggacctttgcacccttattaagactttatgcggtcttagagatcttattccctttaactaataaacaatacaataaatgtaatcaataaagaatcacttacttaaaatcacttagcagatctttatccaatttattcagcagcacctcctttccctcctcccaactctggtacctcagtcgtcttctagctgcaaactttctccacagtttaaatgggatgtcagattcctcttgttcctgcccctccgcacccactattttcatgttgttgcagatgaagcgcgccagaccgtctgaagacaccttcaaccccgtgtacccttatgacacggaaaccggccccccaacagtgcctttccttacccctccctttgtctcccccaatgggttccaagaaagtccccctggggtgctttctctgcgcctttccgaaccactcgtcacctcccacggcatgcttgcgctcaaaatgggcagcggcctagccctggacaaggccggcaaccttacatcacaaaatataaccaccgtcactgagccattaaaaaaaacaaagtccaacataagcctggaaacctccgcgcccctcacagttacatcaggcattcttaccgtagccactgccgcacctttggtggtcgcgggcaacagtcttaccgtgcagtcacaggccccgttaaccgtgcaagactctaaacttagcattgccaccaaaggacccctcacagtgtcagaaggaaagctggccctgcaaacatcgggccccctttctgccactgataacaacacccttactattactacttcaccccctataactactacaaatggtagtttgggtgttaacatggaaaacccactttacaacaacaatggcaaactggggctcagagttgcaggtcctttgcaagtgaccaacgactctcacgcactaacagtaggtacaggtcagggtgttgccattgataataatgcgctacacacaaaagttacaggcgcaatagggtatgatacatctggtaacatggaacttaaaactggagggggagtgcgtgtagacagtgtaaataggcgtcttatactcgatgttgattatccatttgatgcccaaagccaactacgcctaaaactaggacagggacccctatatgtaaactcaagcacacacaacttggatttaaactacaataaaggccttcacttgtttacaactggaaactctaaaaagctagaagtaaatcttaaaacaacaaagggtcttatttttgacaccgatgctgttgcaatacatgcagcacaaggtctagaatttggtaatgatacgtcaacaaatacaaacccacttaaaacaaaactaggattgggattggactatgactcaaacggtggtatgattcccaaacttggaacaggccttagttttgatactacaggggctataacagtgggaaacaaaagcgatgacaaacttaccctgtggacaactcctgacccatcacctaattgtcaaatacactcagaaaaagatgctaagctaacactagttttaactaaatgcggcagtcaggtacttgcaactgtgtcagcactggctgtaaggggcagcctagctcctattagcggaacaataagtagtgctcacattattctcagatttaatgaacatggagtgctaatgaatcattctagtttggatccccaatactggaatttcagaaaaggggatttaacaaacgctacagcatatactaacgcagttggttttatgcccaaccttaaagcttacccaaaaactcaaagtagaactgcaaaaagcaacattgttagtcaggtttatcttaatggagaaaaagaaaaaccaatgacactcactattacacttaatggaactgatgaaaatcaaaccactcccgccagtacatactcaatttcattttcatggagctggcctagcaatcaaacatacattggtcaaacatttgccactaattcctacaccttctcctacattgcccaagaataaagaatcgttgtgttatgtttcaacgtgtttatttttcaattgcaaaaaatttcaagtcatttttcattcagtagtatagccccaccaccacatagcttatattgatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctctcttaagttcatgttgctgtccagctgctgagccacaggctgctgtccaacttgcggttgctcaacgggcggcgaaggggaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataagacgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatgcactgcaaggaaccgggactggaacaatgacagtggagagcccaggactcgtaaccatggatcatcatgctcgtcatgatatcaatgttggcacaacacaggcacacgtgcatacacttcctcaggattacaagctcctcccgcgtcagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtctctgtctcaaaaggaggtaggcgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgtcgcttagctcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaactgccctcacgtccaagtggacgtaaaggctaaacccttcagggtgaatctcctctataaacattccagcaccttcaaccatgcccaaataattttcatctcgccaccttatcaatatgtctctaagtaaatcccgaatattaagtccggccattgtaaaaatctgctccagagcaccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagcaagcacatcgtagtcatgctcatgcagataaaggcaggtaagttccggaaccaccacagaaaaagacaccatttttctctcaaacatgtctgcgggttcctgcataaacacaaaataaaataacaaaaaaaaaaacatttaaacattagaagcctgtcttacaacaggaaaaacaacccttataagcataagacggactacggccatgccggcgtgaccgtaaaaaaactggtcaccgtgattaaaaagcaccaccgacagttcctcggtcatgtccggagtcataatgtaagactcggtaaacacatcaggttggttaacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaaacctattaaaaaacaccactcgacacggcaccagctcaatcagtcacagtgtaaaaagggccaagtacagagcgagtatatataggactaaaaaatgacgtaacggttaaagtccacaaaaaacacccagaaaaccgcacgcgaacctacgcccagaaacgaaagccaaaaaacccacaacttcctcaaatcttcacttccgttttcccacgatacgtcacttcccattttaaaaaaaactacaattcccaatacatgcaagttactccgccctaaaacctacgtcacccgccccgttcccacgccccgcgccacgtcacaaactccaccccctcattatcatattggcttcaatccaaaataaggtatattattgatgatg

SEQ ID NO: 587 - DNA, 35382 bp, ATCC#NIAID V-221-002-014, NIH Research Reagent, prepared in Nov. 1963
ctatctatataatataccttatagatggaatggtgccaatatgcaaatgaggtaatttaaaaaagtgcgcgctgtgtggtgattggctgcggggtgaacggctaaaaggggcgggcaatgctgggaggtgacgtaacttatgtaggaggagttatgttgcaagttatcgcggtaaaggtgacgtaaaacgaggtgtggtttggacacggaagtagacagttttcccacgcttactgacaggatatgaggtagttttgggcggatgcaagtgaaaattctccattttcgcgcgaaaactgaatgaggaagtgaatttctgagtcatttcgcggttatgacagggtggagtatttgccgagggccgagtagactttgaccgtttacgtggaggtttcgattaccgtgtttttcacctaaatttccgcgtacggtgtcaaagtcctgtgtttttacgtaggtgtcagctgatcactagggtatttaaacctgtcgagttccgtcaagaggccactcttgagtgccagcgagaagagttttctcctccgcgctgcgagtcagttttgcgctttgaaaatgagacacctgcgattcctgccacaggagattatctccagcgagaccgggatcgaaatactggagtttgtggtaaataccctgatgggagatgacccggaaccgccagtgcagcctttcgatccacctacgctgcacgatctgtatgatttagaggtagacgggcctgatgatcccaatgaggaagctgtaaatgggttttttactgattctatgctgctagctgccgatgaaggattggacataaaccctcctcctgggacccttgataccccaggggtggttgtggaaagcggcagaggtgggaaaaaattgcctgatctgggagcagctgaaatggacttgcgttgttatgaagagggttttcctccgagtgatgatgaagatggggaaactgaacagtccatccataccgcagtgaatgagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccactttatttacagtaagtgtatttaagtgaaatttaaaggaatagtgtagctgtttaataactgttgaatggtagatttatgtttttacttgcgattttttgtaggtcctgtgtctgatgatgaggcgccttctcctgattcaactacctcacctcctgaaattcaggcgcccgtacctgcaaacgtatgcaagcccattcctgtgaagcctaagtgtgggaaacgccctgctgtggataagcttgaggacttgttggagggtggggatggacctttggaccttagtacccggaaactgccaagacaatgagtgccctgcagctgtgtttatttaatgtgacgtcatgtaataaaattatgtcagctgctgagtgttttattgcttcttgggtggggacttggatatataagtaggagcagatctgtgtggttagctcatagcaacctgctgccatccatggaggtttgggctatcttggaagacctgagacagactaggctactgctagaaaacgcctcggacggagtctctggcttttggagattctggttcggtggtgatctagctaggctagtgtttaggataaaacaggactacagggaagaatttgaaaagttattggacgacagtccaggactttttgaagctcttaacttgggccaccaggctcattttaaggagaaggttttatcagttttagatttttctactcctggtagaactgctgctgctgtagcttttcttacttttatattggataaatggatccgccaaacccacttcagcaagggatacgttttggatttcatagcagcagctttgtggagaacatggaaggctcgcaggatgaggacaatcttagattactggccagtgcagcctctgggagtagcagggatactgagacacccaccggccatgccagcggttctggaggaggagcagcaggaggacaatccgagagccggcctggaccctccggtggaggagtagctgacctgtttcctgaactgcgacgggtgcttactaggtctacgtccagtggacaggacaggggcattaagagggagaggaatcctagtgggaataattcaagaaccgagttggctttaagtttaatgagccgtaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacagtatagaattactaagaagattaatattagaaatgcatgctacatatcagggaatggggcagaggttataatagatacccaagataaagcagcttttagatgttgtatgatgggtatgtggccaggggttgtcggcatggaagcagtaacatttatgaatattaggtttaaaggggatgggtataatggcattgtatttatggctaacactaagctgattctacatggttgtagcttttttgggtttaataatacttgtgtagaagcttgggggcaagttggtgtgaggggttgtagtttttatgcatgctggattgcaacatcaggtagggtcaagagtcagttgtctgtgaagaaatgcatgtttgagagatgtaatcttggcatactgaatgaaggtgaagcaagggtccgccactgcgcagctacagaaactggctgcttcattctaataaagggaaatgccagtgtgaagcataatatgatctgtggacattcgaatgagaggccttatcagatgctgacctgcgctggtggacattgcaatattcttgctaccgtgcatatcgtttcccatgcacgcaagaaatggcctgtatttgaacataatgtgattaccaagtgcaccatgcacataggtggtcgcaggggaatgtttatgccttaccagtgtaacatgaatcatgtgaaggtgatgttggaaccagatgccttttccagagtgagcttaacaggaatctttgatatgaatattcaactatggaagatcctgagatatgatgacactaaaccgagggtgcgcgcatgcgaatgcggaggcaagcatgctagattccagccggtgtgcgtggatgtgactgaagacctgagacccgatcatttggtgcttgcctgcactggagcggagttcggttctagtggtgaagaaactgactaaagtgagtagtggggcaatatgtggatggggactttcaggttggtaaggtggacagattgggtaaattttgttaatttctgtcttgcagctgccatgagtggaagcgcttcttttgaggggggagtatttagcccttatctgacgggcaggctcccatcatgggcaggagttcgtcagaatgtcatgggatccactgtggatgggagacccgtccagcccgccaattcctcaacgctgacctatgccactttgagttcgtcatcattggatgcagctgcagccgccgccgctactgctgccgccaacaccatccttggaatgggctattacggaagcatcgttgccaattccagttcctctaataacccttcaaccctggctgaggacaagctgcttgttctcttggctcagctcgaggccttaacccaacgcttaggcgaactgtctaagcaggtggcccagttgcgtgagcaaactgagtctgctgttgccacagcaaagtctaaataaagatctcaaatcaataaataaagaaatacttgttataaaaacaaatgaatgtttatttgatttttcgcgcgcggtatgccctggaccatcggtctcgatcattgagaactcggtggatcttttccagtaccctgtaaaggtgggattgaatgtttagatacatgggcattagtccgtctcgggggtggagatagctccattgaagagcctcttgctccggggtagtgttataaatcacccagtcatagcaaggtcggagtgcatggtgttgcacaatatcttttaggagcagactaattgcaacggggaggcccttagtgtaggtgtttacaaatctgttgagctgggacgggtgcatcctgggtgaaattatatgcattttggactggatcttgaggttggcaatgttgccgcctagatcccgtctcggattcatattgtgcagaaccaccaagacagtgtatccggtgcacttgggaaatttatcatgcagcttagagggaaaagcatgaaaaaatttggagacgcctttgtgaccccccagattctccatgcactcatccataatgatagcgatggggccgtgggcagcggcacgggcgaacacgttccgggggtctgaaacatcatagttatgctcctgagtcaggtcatcataagccattttaataaactttgggcggagggtgccagattgggggatgaaagttccctctggcccgggagcatagtttccctcacatatttgcatttcccaggctttcagttccgagggggggatcatgtccacctgcggggctataaaaaataccgtttctggagccggggtgattaactgggatgagagcaaattcctaagcagctgagacttgccgcacccagtgggaccgtaaatgaccccaattacgggttgcagatggtagtttagggagcgacagctgccgtcctcccggagcaggggggccacttcgttcatcatttcccttacatggatattttcccgcaccaagtccgttaggaggcgctctcccccaagggatagaagctcctggagcgaggagaagtttttcagcggcttcagcccgtcagccatgggcattttggaaagagtctgttgcaagagctcgagccggtcccagagctcggtgatgtgctctatggcatctcgatccaacagacctcctcgtttcgcgggttgggacggctcctggagtagggaatcagacgatgggcgtccagcgctgctagggtccgatccttccatggtcgcagcgtccgagtcagggttgtttccgtcacggtgaaggggtgcgcgcctggttgggcgcttgcgagggtgcgcttcagactcatcctgctggtcgagaaccgctgccgatcggcgccctgcaggtcggccaggtagcagtttaccatgagttcgtagttgagcgcctcggccgcgtggcctttggcacggagcttacctttggaagttttatggcaggcggggcagtagatacatttgagggcatacagcttgggcgcgaggaaaatggattcgggggagtatgcatccgcaccgcaggaggcgcagacggtttcgcactccacgagccaggtcagatccggctcatcggggtcaaaaacaagttttccgccatgttttttgatgcgtttcttacctttggtttccatgagttcgtgtccccgctgggtgacaaagaggctgtccgtgtccccgtagaccgactttatgggcctgtcctcgagcggagtgcctcggtcctcttcgtagaggaacccagcccactctgatacaaaagcgcgtgtccaggccagcacaaaggaggccacgtgggaggggtagcggtcgttgtcaaccagtgggtccaccttctctacggtatgtaaacacatgtccccctcctccacatccaagaatgtgattggcttgtaagtgtaggccacgtgaccaggggtccccgccgggggggtataaaagggggcgggcctctgttcgtcctcactgtcttcaggatcgctgtccaggagcgccagctgttggggtaggtattccctctcgaaggcgggcatgacctctgcactcaggttgtcagtttctaggaacgaggaggatttgatattgacagtaccagcagagacgcctttcataagactctcgtccatctggtcagaaaacacaatcttcttgttgtccagcttggtggcaaatgatccataaagggcattggacagaagcttggcgatggagcgcatggtttggttcttttccttgtccgcgcgctccttggcggcgatgttaagctggacgtactcgcgcgccacacatttccattcagggaagatggttgtcagttcatccggaactattctgactcgccatcccctattgtgcagggttatcagatccacactggtggccacctcgcctcggaggggctcattggtccagcagagtcgacctccttttcttgaacagaaaggtgggagggggtctagcatgaactcatcaggggggtccgcatctatggtaaatattcccggtagcaaatctttgtcaaaatagctgatggtggcgggatcatccaaggtcatctgccattctcgaactgccagcgcgcgctcataggggttaagaggggtgccccagggcatggggtgggtgagcgcggaggcatacatgccacagatatcgtagacatagaggggctcttcgaggatgccgatgtaagtgggataacagcgcccccctctgatgcttgctcgcacatagtcatagagttcatgtgagggggcgagaagacccgggcccagattggtgcggttgggtttttccgccctgtaaacgatctggcgaaagatggcatgggaattggaagagatagtaggtctctggaatatgttaaaatgggcatgaggtaggcctacagagtcccttatgaagtgggcatatgactcttgcagcttggctaccagctcggcggtgacgagtacatccagggcacagtagtcgagagtttcctggatgatgtcataacgcggttggcttttcttttcccacagctcgcggttgagaaggtattcttcgcgatccttccagtactcttcgaggggaaacccgtctttttctgcacggtaagagcccaacatgtagaactgattgactgccttgtagggacagcatcccttctccactggaagagagtatgcttgggctgcattgcgcagcgaggtatgagtgagggcaaaagtgtccctgaccatgactttgaggaattgatacttgaagtcaatgtcatcacaggccccctgttcccagagttggaagtccacccgcttcttgtaggcggggttgggcaaagcgaaagtaacatcattgaagaggatcttgccggccctgggcatgaaatttcgggtgattttgaaaggctgagggacctctgctcggttattgataacctgagcggccaagacgatctcatcaaagccattgatgttgtgccccactatgtacagttctaagaatcgaggggtgcccctgacatgaggcagcttcttgagttcttcaaaagtgagatctgtagggtcagtgagagcatagtgttcgagggcccattcgtgcacgtgagggttcgctttgaggaaggaggaccagaggtccactgccagtgctgtttgtaactggtcccggtactgacgaaaatgctgcccgactgccatcttttctggggtgacgcaatagaaggtttgggggtcctgccgccagcgatcccacttgagtttcatggcgaggtcataggcgatgttgacgagccgctggtctccagagagtttcatgaccagcatgaaggggattagctgcttgccaaaggaccccatccaggtgtaggtttccacatcgtaggtgaggaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtactcgcagcgattcacgggatgcacctcatgaatgagttgtacctgacttcctttgacgagaaatttcagtggaaaattgaggcctggcgtttgtacctcgcgctctactatgttgtctgcatcggcatgaccatcttctgtctcgatggtggtcatgctgacgagccctcgcgggaggcaagtccagacctcggcgcggcaggggcggagctcgaggacgagagcgcgcaggccggagctgtccagggtcctgagacgctgcggagtcaggttagtaggcagtgtcaggagattgacttgcatgatcttttcgagggcgtgagggaggttcagatggtacttgatctccacgggtccgttggtggagatgtcgatggcttgcagggttccgtgccccttgggtgctaccaccgtgcccttgtttttccttttgggcggcggtggctctgttgcttcttgcatgtttagaagcggtgtcgagggcgcgcaccgggcggcaggggcggttcgggacccggcggcatggctggcagtggtacgtcggcgccgcgcgcgggtaggttctggtactgtgctctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcgccagagttgtcctggtaggcgatctcggccatgaactgctcgatctcttcctcttgaagatctccgcggcccgctctctcgacggtggccgccaggtcgttggagatgcgcccaatgagttgagagaatgcattcatgcccgcctcgttccagacgcggctgtagaccacagcccccacgggatctctcgcgcgcatgaccacctgggcgaggttgagctccacgtggcgggtgaagaccgcatagttgcatagacgctggaaaaggtagttgagtgtggtggcgatgtgctcggtgacgaagaaatacatgatccatcgtctcagcggcatctcgctgacatcgcccagcgcttccaagcgctccatggcctcgtagaagtccacggcaaagttgaaaaactgggagttacgcgcggacacggtcaactcctcttccagaagacggatgagttcggcgacggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtctcggtgacggcacgaccgttctccctgggtctcagagtgaagacgcctccgcgcatctccctgaagtggtgactgggaggctctccgttgggcagggacaccgcgctgattatgcattttatcaattgccccgtaggtactccgcgcaaggacctgatcgtctcaagatccacgggatctgaaaacctttcgacgaaagcgtctaaccagtcgcaatcgcaaggtaggctgagcactgtttcttgcgggcgggggcggctagacgctcggtcggggttctctctttcttctccttcctcctctttggagggtgagacgatgctgctggtgatgaaattaaaataggcagttttgagacggcggatggtggcgaggagcaccaggtctttgggtccggcttgttggatgcgcaggcgatgggccattccccaagcattatcctgacatctggccagatctttatagtagtcttgcatgagtcgttccacgggcacttcttcttcgcccgctctgccatgcatgcgagtgatcccgaacccgcgcatgggctggacaagtgccaggtccgctacaaccctttctgcgaggatggcttgctgcacctgggtgagggtggcttggaagtcgtcaaagtccacgaagcggtggtaagccccggtgttgattgtgtaggagcagttggccatgactgaccagttgactgtctggtgccccggacgcacaatctcggtgtacttgaggcgcgagtaggcgcgggtgtcaaagatgtaatcgttacaggtgcgcaccaggtactggtagccgataagaaagtgcggcggcggctggcggtataggggccatcgctctgtagccggggcgccaggggcgaggtcttccagcatgaggcggtgataaccgtagatgtacctggacatccaggtgataccggaggcggtggtggatgcccgcgggaactcgcgtacgcggttccagatgttgcgcagcggcatgaagtagttcatggtaggcacggtttggcccgtgagacgtgcacagtcgttgatgctctagacatacgggcaaaaacgaaagcggtcagcggctcgtctccgtggcctggaggctaagcgaacgggttgggctgcgcgtgtaccccggttcgaatctcggatcaggctggagccgcagctaacgtggtactggcactcccgtctcgacccaggcctgcacaaaacctccaggatacggaggcgggtcgtttttttttttttttgctttttcctggatgggagccagtgctgcgtcaagctttagaacactcagttctcggggctgggagtggctcgcgcccgtagtctggagaatcaatcgccagggttgcgttgcggtgtgccccggttcgagtcttagcgcgccggatcggccggtttccgcgacaagcgagggtttggcagccccgtcatttctaagaccccgccagccgacttctccagtttacgggagcgagccctctttttttgtttttttgttgcccagatgcatcccgtgctgcgacagatgcgcccccagcaacagcccccttctcagcagcagctacaacaacagccacaaaaggctcttcctgctcctgtaactactgcggctgcagccgtcagcggcgcggggcagcccgcctatgatctggacttggaagagggcgagggactggcgcgcctgggcgcaccatcgcccgagcggcacccgcgggtgcaactgaaaaaggactctcgcgaggcgtacgtgccccagcagaacctgttcagggacaggagcggcgaggagcctgaggaaatgcgagcttcccgctttaacgcgggtcgcgaactgcgtcacggtctggaccgaagacgggtgctgcgtgatgatgattttgaagtcgatgaagtgacaggaataagtcctgctagggcacatgtggccgcggccaacctagtatcagcttacgagcagaccgtgaaggaggagcgcaactttcaaaaatctttcaacaaccatgtgcgcaccctgattgcccgcgaggaagtgacactgggactgatgcacctgtgggacctgatggaagccattacccagaaccccaccagcaaacctctaaccgctcagctgtttctggtggtgcaacatagtagagacaatgaggcatttagggaggcgctgttgaacattactgagcccgaggggagatggttgtatgatcttatcaatattctgcaaagtataatagtgcaagaacgtagcctgggtctagctgagaaggtggctgctattaactactcggtcttgagcctgggcaagcactacgctcgcaagatctacaaaaccccatacgtacctatagacaaggaggtgaagatagatgggttttatatgcgcatgactctcaaggtgctgaccttgagtgacgatctgggagtgtaccgcaacgacaggatgcaccgcgcagtgagcgccagcagaaggcgtgagctgagcgacagagaacttatgcacagcttgcaaagagctctgactggggctggaaccgagggggagaactactttgacatgggagcggacttgcaatggcagcccagtcgcagggccctggacgcagcagggtatgagcttccttacatagaagaggtggatgaaggccaggatgaggagggcgagtacctggaagactgatggcgcgaccatccatatttttgctagatggaacagcaggcaccggaccccgcaaaacgggcggcgctacagagccagccgtccggcattaactcctcggacgattggagccaggccatgcaacgcatcatggcgctgacgacccgcaaccccgaagcctttaggcagcaaccccaggccaaccgcctttctgctatcctggaggccgtagtgccctcccgctccaaccccacacacgagaaggtcctggccatcgtgaacgcgctggtggagaacaaagccatacgtcccgatgaggctgggctggtatacaatgccctattggagcgcgtagcccgctacaacagcagcaacgtgcagaccaacctggaccggatggtgaccgatgtgcgcgaggccgtgtctcagcgcgagcggttccagcgagacgccaatttagggtcgctggtggctttgaacgccttcctcagcactcagcctgccaacgtgcctcgcggtcagcaagactacacaaactttctaagtgcattgagactcatggtggccgaagtccctcaaagcgaagtgtaccagtccgggccagactactttttccagaccagcagacagggcttgcagacagtgaacctgagccaggcttttaagaacctgaatggtctgtggggagtgcgcgccccagtgggagatcgggcgaccgtgtctagcttgctgacccccaactcccgcctactactgctcttggtagccccattcactgacagcggtagcatcgaccgtaattcgtacttgggctatctgttgaacctgtatcgcgaggccatagggcaaactcaggtagatgagcaaacctatcaagaaattacccaagtgagccgcgctctgggtcgggaggacactggcagcttggaagccaccttaaacttcttgctgaccaaccggtcgcagaagatccctcctcagtatgcgcttaccgcggaggaggaacggatcctgagatacgtgcagcagagcgtgggactgttcctaatgcaggagggggcgactcctactgctgcgctcgatatgacagcccgaaacatggagcccagcatgtatgccagtaaccggccttttatcaataaactgctagactacttacacagggcggctgctatgaactctgattatttcaccaatgctatcctgaacccccattggctgcccccacctgggttctatacgggcgagtatgacattgcccgacccaatgacgggtttttatgggacgatgtggacagtagtgttttctccccgcctcctggttataacacttggaagaaggaaggtggcgatagaaggcactcttccgtgtcactgtccggggcaacgggtgctgccgcagcggctcccgaggccgcaagtcctttccctagtttgccattttcgctaaacagtgtacgcagcagtgagctgggaagaataacccgtcctcgcttgatcggcgaggaggagtatttgaacgactccctgttgagacccgagagggagaagaatttccccaacaacgggatagaaagcttggttgacaaaatgaaccgctggaagacgtacgcgcacgatccccgggcgctgggggatagccggggcagcgctacccgtaaacgccagtggcacgacaggcagcggggcctggtgtgggccgatgatgattccgccgacgacagcagcgtgttggacttgggtgggagtggtggtaacccgttcgctcacctgcgcccccgcgtcgggcgcctgatgtaagaaaccgaaaataaatactcaccaaggccatggcgaccagcgtgcgttcgtttcttctctgttatatctagtatgatgaggcgaaccgtgctaggcggagcggtggtgtatccggagggtcctcctccttcgtacgagagcgtgatgcagcaggcggcggcggcgacgatgcagccaccactggaggctccctttgtaccccctcggtacctggcacctacggaggggagaaacagcattcgttactcggagctggcaccattgtatgataccacccggttgtatttggtggacaacaagtccgcggacatcgcctcactgaactatcagaacgaccacagcaacttcctcaccacggtggtgcaaaacaatgactttacccccacggaggccagcacccagaccatcaactttgacgagcggtcgcgatggggcggtcagctgaagactatcatgcacaccaacatgcccaacgtgaacgagtacatgtttagcaacaagttcaaagctcgggtgatggtgtctagaaaggctcctgaaggtgtcacagtagatgacaattatgatcacaagcaggatattttggaatatgagtggtttgagtttactctaccggaagggaatttctcagccacaatgaccattgacctaatgaacaatgccatcattgataattaccttgaagtgggcagacagaatggagtgttagagagtgacattggtgttaaatttgacaccaggaactttagactgggttgggatccggaaactaagttgattatgcctggggtttacacctatgaggcattccatcctgacattgtattgttgcctggttgcggagttgactttactgaaagtcgccttagtaacttgcttggtatcaggaaaagacacccattccaggagggttttaagatcttgtatgaggatcttgaagggggtaatatcccggccctgttggatgtagaagcctatgagaacagtaagaaagaacaagaagccaaaacagaagccgctaaagctgctgctattgctaaagccaacatagttgtcagcgaccctgtaagggtggctaatgcagaagaagtcagaggagacaactatacagcttcatctgttgcaactgacgaatcgctattggctgctgtggccgaaactacagagacaaaactcactattaaacctgtagaaaaagacagcaagagtagaagttacaatgtcttggaagataaagtgaatacagcctaccgcagctggtacctgtcctacaactatggtgaccctgaaaaaggagtccgttcctggacactgctcaccacctcggatgtcacctgtggagcagagcaggtgtactggtcgctcccagacatgatgcaggaccctgtcacattccgttccacgagacaagtcagcaactatccagtggtaggtgcagagctcatgccggtcttctcaaagagtttctacaacgagcaagccgtgtactcccagcagcttcgccagtccacctcgctcacgcacgtcttcaaccgcttccctgagaaccagatcctcatccgcccgccagcgcccaccattaccaccgtcagtgaaaacgttcctgctctcacagatcacgggaccctgccgttgcgcagcagtatccggggagtccagcgcgtgaccgttactgacgccagacgccgcacctgcccctacgtctacaaggccctgggcatagtcgcgccgcgcgtcctttcaagccgcactttctaaaaaaaaaaatgtccattcttatctcacctagtaataacaccggttggggcctgcgcgcgccaagcaagatgtacggaggtgctcgcaaacgctctacacagcaccctgtgcgcgtgcgcgggcacttccgcgctccatggggcgccctcaagggtcgtgcccgcactagaaccaccgtcgatgatgtgatcgaccaggtggtggccgatgctcgtaattatactcctactgcacctacatctactgtggatgcagttattgacagcgtagtggctgacgcccgcgcctatgctcgccggaagagcaggcggagacgcatcgccaggcgccaccgggctactcccgctatgcgagcggcaagagctctgctacggagggccaaacgcgtggggcgaagagctatgcttagagcggccagacgcgcggcttcaggtgccagtgccggcaggtcccgcaggcgcgcagccacggcggcagcagcggccattgccaacatggcccaaccgcgaagaggcaatgtgtactgggtgcgcgacgccaccaccggccagcgcgtgcccgtgcgcacccgcccccctcgctcttagaagatactgagcagtctccgatgttgtgtcccagcgaggatgtccaagcgcaaatacaaggaagagatgctccaggtcatcgcgcctgaaatctacggtccgccggtgaaggatgaaaaaaagccccgcaaaatcaagcgggtcaaaaaggacaaaaaggaagaagatggcaatgatggtctggcggagtttgtacgcgagttcgccccaaggcggcgtgtgcagtggcgtggacgcaaagtgcggcctgtgctgagacctggaaccacggtggtctttacgcccggcgagcgctccagcactgcttttaagcggtcctatgatgaggtgtatggggatgatgatattctggagcaggcggccgaccgcctgggcgagtttgcttatggcaagcgctcccgctcgagccccaaggaggaggcggtgtccattcccttggacaatgggaatcccacccctagtctcaagccagtcaccctgcagcaagtgctgcccgtgcctccacgcagaggcaacaagcgagagggtgaggatctgtatcccactatgcaattgatggtgcccaagcgccagcggctggaggacgtgctggagaaaatgaaagtggatcccgatatacaacctgaggtcaaagtgagacccatcaagcaggtggcgccaggtttgggagtacaaaccgtagacatcaagattcccaccgagtccatggaagtccaaaccgaacctgcaaagcccacaaccacctccattgaggtgcaaacggatccctggatgaccgcacccgttacaactccagctgctgtcaacaccactcgaagatcccggcgaaagtacggtccagcaagtttgctgatgccaaattatgctctgcacccatccattattccaactccgggttaccgaggcactcgctactaccgcagcaggagcagcacttcccgccgtcgccgcaaaacacctgcaagtcgtagtcaccgtcgtcgccgccgccccaccagcaatctgactcccgctgctctggtgcggagagtgtatcgcgatggccgcgcggatcccctgacgttgccgcgcgtacgctaccatccaagcatcacaacttaacaactgttgccgctgcctccttgcagatatggccctcacttgccgccttcgtgtccccattactggctaccgaggaagaaactcgcgccgtagaagagggatgttggggcgcggaatgcgacgccacaggcggcggcgcgctatcagcaagaggctggggggtggctttctgcctgctctgatccccatcatagccgcggcgatcggggcgataccaggcatagcttccgtggcggttcaggcctcgcagcgccactgacattggaaaaacttataaataaaacagaatggactctgatgctcctggtcctgtgactatgtttttgtagagatggaagacatcaatttttcatccctggctccgcgacacggcacgaggccgtacatgggcacctggagcgacatcggcaccagccaactgaacgggggcgccttcaattggagcagtatctggagcgggcttaaaaattttggctctaccataaaaacctatgggaacaaagcttggaacagcagcacagggcaggcattgagaaataagcttaaagagcaaaacttccaacagaaggtggttgatggaatcgcctctggtatcaatggggtggtggatctggccaaccaggccgtgcagaaacagataaacagccgcattgacccgccgccgtcagccccgggtgaaatggaagtggaggaagatctccctccccttgaaaagcggggcgacaagcgtccgcgccccgatctggaggagacactagtcacacgctcagacgacccgccctcctacgaggaggcagtgaagcttggaatgcccaccaccagacctgtagcccccatggctaccggggtaatgaaaccttctcagtcacaccgacccgctaccttggacttgcctccccctgctgttgcagcgcctgctcgcaagcctgtcgctaccccgaagcccaccaccgtacagcccgtcgccgtagccagaccgcgtcctgggggcactccacgtccgaatgcaaactggcagagtactctgaacagcatcgtgggtctgggcgtgcaaagtgtaaagcgccgtcgctgcttttaaattaatatggagtagcgcttaacttgcctgtctgtgtgtatgtgtcatcatcacgccgccgccgcagcaacagcagaggagcaaggaagaggtcgcgcgccgaggctgagttgatttcaagatggccaccccatcgatgctgccccagtgggcatacatgcacatcgccggacaggatgcttcggagtacctgagtccgggtctggtgcagttcgcccgcgccacagacacctacttcaatctggggaacaagtttaggaaccccaccgtggcgcccacccatgatgtgaccaccgaccgcagtcagcggctgatgctgcgctttgtgcccgttgaccgggaagacaatacctacgcatacaaagttcgatacaccttggctgtgggcgacaacagagtgctggatatggccagcactttctttgacattcggggtgtgttggatagaggccctagcttcaagccatactctggcactgcttacaactcgttggcccctaagggcgctcccaatacatctcagtggattgctgaaggcgtaaaaaaagaagatgggggatctgacgaagaggaagagaaaaatctcaccacttacacttttggaaatgccccagtgaaagcagaaggtggtgatatcactaaagacaaaggtcttccaattggttcagaaattacagacggcgaagccaaaccaatttatgcagataaactataccaaccagaacctcaggtgggagatgaaacttggactgacacagatggaacaactgagaagtatggtggtagagctctaaagccagaaactaaaatgaaaccctgctatgggtcttttgctaaacccactaacgtcaaaggcggacaggcaaaacaaaaaactactgaacaaccgcaaaaccagcaggttgaatatgatattgacatgaacttttttgatgaagcgtcacagaaagcaaacttcagtccaaaaattgtgatgtatgcagaaaatgtagacttggaaaccccagacactcatgtggtgtacaaacctggtacttcagaagaaagttctcatgctaatctgggtcaacaatctatgcccaacagacccaactacattggctttagagataactttattggacttatgtactacaacagtactggcaacatgggagtgctggcaggtcaagcatcccaattgaatgcggtggttgacttgcaggacagaaacacagaactatcatatcaactactgcttgactctctgggtgacagaaccagatacttcagcatgtggaatcaagcagtcgatagctatgatcctgatgtgcgcattattgaaaatcatggggtggaagatgagcttcccaactactgctttccattggatggagtaggggtaccaataagtagttacaaaataattgaaccaaacggacagggtgcagattggaaagagcctgacataaatggaacaagtgaaattggacaaggaaatctctttgccatggaaattaacctccaagctaatctctggagaagttttctttattccaatgtggctctgtatctcccagactcctacaaatacaccccagccaatgtcactcttccaactaacaccaacacttatgactacatgaatgggcgggtggttcccccatccctggtggatacctacgtaaacattggcgccagatggtctttggatgccatggacaatgtcaacccctttaaccatcaccgcaacgctggcctgcgataccggtccatgcttttgggcaatggtcgttacgtgcctttccacattcaagtgcctcagaaattctttgctgtgaagaacctgctgcttctacccggttcttacacctacgagtggaacttcagaaaggatgtgaacatggtcctgcagagttcccttggtaatgatctccgggtcgatggtgccagcataagttttaccagcatcaatctctatgccaccttcttccccatggcccacaacactgcctccacccttgaagccatgctgcgcaatgacaccaatgatcaatcattcaatgactacctttctgctgccaacatgctctaccccatcccggccaacgctaccaacgttcccatctccattccctctcgcaactgggccgccttcagaggctggtccttcaccagactcaaaaccaaggagactccctctttgggatcagggttcgatccctactttgtttactctggttctataccctacctggatggtaccttctaccttaaccacactttcaagaaagtctccatcatgtttgactcttcagtgagctggcctggtaatgacagattgctaagtccaaatgagttcgaaatcaagcgcacagttgatggggaaggctacaatgtggcccaatgtaacatgaccaaagactggttcctggtccagatgcttgccaactacaacattggataccagggcttctacgttcctgagggttacaaggatcgcatgtactccttcttcagaaacttccagcccatgagtagacaggtggttgatgagattaactacaaagactataaagctgtcgccgtaccctaccagcataataactctggctttgtgggttacatggctcctaccatgcgtcagggtcaagcgtaccctgctaactacccataccccctaattggaaccactgcagtaaccagtgtcacccagaaaaaattcctgtgcgacaggaccatgtggcgcatcccattctctagcaacttcatgtccatgggtgcccttacagacctgggacagaacttgctgtatgccaactcggcccatgcgctggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataagaagcctcttgcttcttgcaagcagcagctgcagccatgtcatgcgggtccggaaacggctccagcgagcaagagctcaaagccatcgtccgagacctgggctgcggaccctatttcctgggaacctttgacaagcgtttcccggggttcatggcccccgacaagctcgcctgcgccatagtcaacactgccggacgcgagacggggggagagcactggctggcttttggttggaacccgcgctccaacacctgctacctttttgatccttttgggttctcggatgagcgactcaaacagatttaccagtttgagtacgaggggctcctgcgccgcagtgcccttgctaccaaagaccgctgcatcaccctggaaaagtccacccagagcgtgcagggcccgcgctcagccgcctgtggacttttttgctgtatgttccttcatgcctttgtgcactggcccgaccgccccatgaacggaaaccccaccatgaagttgctgactggggtgtcaaacagcatgctccaatcaccccaagtccagcccaccctgcgtcgcaaccaggaggcgctatatcgcttcctaaacacccactcatcttactttcgttctcaccgcgcacgcatcgaaagggccaccgcgtttgaccgtatggatatgcaataagtcatgtaaaaccgtgttcaataaaaagcactttatttttacatgcactaaggctctggttttttgctcattcgttttcatcattcactcagaaatcaaatgggttctggcgtgagtcagagtgacccgtgggcagggagacgttgcggaactgtaacctgttctgccacttgaactcggggatcaccagcttgggaactggaatttcgggaaaggtgtcttgccacaactttctggtcagttgcagggcgccaagcaggtcaggagcagagatcttgaaatcacagttggggccggcattctggacacgggagttgcggtacactgggttgcaacactggaacaccatcaaggctgggtgtctcacgcttgccagcacggtcgggtcactgatggtagtcacatccaagtcttcagcattggccattccaaagggggtcatcttacaggtctgcctgcccatcacgggagcgcagcctggcttgtggttgcaatcgcaatgaatggggatcagcatcatcctggcttggtcgggggttatccctgggtacacggccttcatgaaggcttcgtactgcttgaaagcttcctgagccttacttccctcggtgtaaaacatcccacaggacttgctggaaaattggttagtagcacagttggcatcattcacacagcagcgggcatcgttgttggccaactggaccacatttctgccccagcggttctgggtgatcttggctctgtctgggttctccttcatagcgcgctgcccgttttcgctcgccacatccatctcgataatgtggtccttctggatcataatagtgccatgcaggcatttcaccttgccttcgtaatcggtgcatccatgagcccacagagcgcacccggtgcactcccaattattgtgggcgatctcagaataagaatgcaccaatccctgcatgaatcttcccatcatcgctgtcagggtcttcatgctactaaatgtcagcgggatgccacggtgctcctcgttcacatactggtggcagatacgcttgtactgctcgtgctgctctggcatcagcttgaaagaggttctcaggtcattatccagcctatacctctccattagcacagccatcacttccatgcccttctcccaggcagataccaggggcaagctcaaaggattcctaacagcaatagaagtagctcctttagctatagggtcattcttgtcgatcttctcaacacttctcttgccatccttctcaatgatgcgcaccggggggtagctgaagcccacggccaccaactgagcctgttctctttcttcttcgctgtcctggctgatgtcttgcagagggacatgcttggtcttcctgggcttcttcttgggagggatcgggggaggactgttgctccgttccggagacagggatgaccgcgaagtttcgcttaccagtaccacctggctctcgatagaagaatcggaccccacgcgacggtaggtgttcctcttcgggggcagaggtggaggcgactgagatgggctgcggtccggccttggaggcggatggctggcagagcccattccgcgttcgggggtgtgctcccgttggcggtcgcttgactgatttcctccgcggctggccattgtgttctcctaggcagagaaacaacagacatggaaactcagccatcactgccaacatcgctgcaagcgccatcacacctcgcccccagcagcgacgaggaggagagcttaaccaccccaccacccagtcccgctaccaccacctctaccctcgatgatgaggaggaggtcgacgcagcccaggagatgcaggcgcaggataatgtgaaagcggaagagattgaggcagatgtcgagcaggacccgggctatgtgacaccggcggagcacgaggaggagctgaaacgttttctagacagagaggatgacgaccgcccagagcatcaccaggaggctggcctcggggatcatgttgccgactacctctccgggcttgggggggaggacgtgctcctcaaacatctagcaaggcagtcgatcatagttaaagacgcactactcaacctcaccgaagtgcccatcagtgtggaagagcttagccgcgcctacgagctgaacctcttttcgcctcagataccccccaagcggcagcgaaacggcacctgcgaggccaaccctcgactcaacttctatccagcttttactgtccccgaagtgctggccacctaccacatcttttttaagaaccaaaagattccagtctcctgccgcgccaaccgcacccgcgcagatgcccttctcaacttgggtccgggagctcgtttacctgatatagcttccttggaagaggttccaaagatctttgagggtctgggaagtgatgagactcgggccgcaaatgctctgcaacagggagagaatggcatggatgaacatcacagcgctctagtggaactggagggtgacaatgcccggcttgcagtgctcaagcgcagtatcgtggtcacccattttgcctaccccgctgttaacctgccgcccaaagtcatgagcgctgtcatggaccatctgctcatcaaacgagcaagtccactttcagaaaaccagaacatgcaggatccagacgcctcggacgagggcaagccggtagtcagtgacgagcagctatctcgctggctgggtaccaactccccccgagatttggaagaaagacgcaagcttatgatggctgtagtgctagtaactgttgagttggagtgtctgcgccgcttttttaccgaccccgagaccctgcgcaagctagaggagaacctgcactacaccttcagacatggcttcgtgcgccaggcatgcaagatctccaacgtggagctcaccaacctggtttcatacatgggcattttgcatgagaaccggctagggcagagcgttctgcacaccaccctgaagggggaggcccgccgcgactacatccgagactgtgtctacctctacctctgccatacctggcagactggtatgggtgtgtggcaacagtgtttggaagagcagaaccttaaagagctggacaagctcttgcagagatccctcaaagccctgtggacaggttttgacgagcgcaccgtcgcctcggacctggcggacatcatcttccccgagcgtcttagggttactctgcgaaacggcctgccagacttcatgagccagagcatgcttaacaactttcgctctttcatcctggaacgctccggtatcctgcctgccacctgctgtgcgctgccctccgactttgtgcctctcacctaccgcgagtgcccaccgccgctatggagccactgctacctattccgcctggccaactacctctcctaccactcggatgtgatagaggatgtgagcggagacggcctgctggaatgccactgccgatgcaatttatgcacaccccaccgctccctcgcctgcaacccccagttgctaagcgagacccagatcatcggcaccttcgagttgcagggtcccaacagtgaaggcgaggggtcttctccggggcagagtctgaaactgacaccggggctgtggacctccgcctacctgcgcaagttttatcccgaggactatcatccctatgagatcaggttctatgaggaccagtcacatcctcccaaagtcgagctctcagcctgcgtcatcacccagggggcaattctggcccaattgcaagccatccaaaaatcccgccaagaatttctgctgaaaaagggaagcggggtctaccttgacccccagaccggtgaggagctcaacacaaggttcccccaggatgtcccatcgccgaggaagcaagaagctgaaggtgcagctgtcacccccagaggatatggaggaagactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggggcccagcggcggcccaacagtagatgggacgagaccgggcgatttccaaacccgaccaccgcttccaagaccggtaagaaggagcgacagggatacaagtcctggcgtggacataaaaacgctatcatctcctgcttgcatgaatgcgggggcaacatatccttcacccggcgatacctgcttttccaccacggtgtgaacttcccccgcaatatcttgcattactaccgtcacctccacagcccctactgcagtcagcaagtcccggcaaccccgacagaaaaagacagcagcgacaacggtgaccagaaaaccagcagttagaaaatccacaacaagtgcagcaggaggaggactgaggatcacagcgaacgagccagcgcagaccagagagctgaggaaccggatctttccaaccctctatgccatcttccagcagagtcgggggcaagagcaggaattgaaagtaaaaaaccgatctctgcgctcgctcaccagaagttgtttgtatcacaagagcgaagaccaacttcagcgcactctcgaggacgccgaggctctcttcaacaagtactgcgcgctgactcttaaagagtagcccttgcccgcgctcattcgaaaacggcgggaatcacgtcacccttggcagctgtcctttgccctcgtcatgagtaaagacattcccacgccttacatgtggagctatcagccccaaatggggttggcagcaggtgcttcccaggactactccacccgcatgaattggcttagcgccgggccctcaatgatatcacgggttaatgatatacgagcttatcgaaaccagttactcctagaacagtcagctcttaccaccacaccccgccaacaccttaatccccgaaattggcccgccgccctggtgtaccaggaaaatcccgctcccaccaccgtactacttcctcgagacgcccaggccgaagttcagatgactaacgcaggtgtacagctggcgggcggttccgccctatgtcgtcaccggcctcaacagagtataaaacgcctggtgatcagaggccgaggtatccagctcaacgacgagtcggttagctcttcgcttggtctgcgaccagacggagtcttccagatcgccggctgtgggagatcttccttcactcctcgtcaggctgtgctgactttggagagttcgtcctcgcagccccgctcgggcggcatcggaactctccagtttgtggaggagtttactccctctgtctacttcaaccccttctccggctctcctggccagtacccggacgagttcataccgaacttcgacgcaatcagcgagtcagtggatggctatgattgatgtctaatggtggcgcggctgagctagctcgactgcgacacctagaccactgccgccgctttcgctgtttcgcccgggaactcaccgagttcatttacttcgaactctccgaggagcaccctcagggtccggcccacggagtgcggattaccatcgaagggggaatagactctcgcctgcatcgcatcttctcccagcggcccgtgctgattgagcgcgaccagggaaatacaaccatctccatctactgcatctgtaaccaccccggattgcatgaaagcctttgctgtcttgtttgtgctgagtttaataaaaactgagttaagaccctcctacggactaccgcttcttcaatcaggactttacaacaccaaccagatcttccagaagacccagacccttcctcctctgatccaggactctaactctaccttaccagcaccctccactactaaccttcccgaaactaacaagcttggatctcatctgcaacaccgcctttcacgaagccttctttctgccaatactaccactcccaaaaccggaggtgagctccgcggtcttcctactgacgacccctgggtggtagcgggttttgtaacgttaggattagttgcgggtgggcttgtgctaatcctttgctacctatacacaccttgctgtgcatatttagtcatattgtgctgttggtttaagaaatgggggccatactagtcgtgcttgctttactttcgcttttgggtctgggctctgctaatctcaatcctcttgatcacgatccatgtctagacttcgacccagaaaattgcacacttacttttgcacccgacacaagccgtctctgtggagttcttattaagtgcggatgggactgcaggtccgttgaaattacacataataacaaaacatggaacaatacattatccaccacatgggaaccaggagttcccgagtggtatactgtctctgtccgaggtcctgacggttccattcgcattagtaacaacactttcattttttctgaaatgtgcgatctggccatgtttatgagcaaacagtatgacctatggcctcctagcaaagagaacattgtggcattttccattgcttattgcttggtaacatgcatcatcactgctatcatttgtgtgtgcatacacttgcttatagttattcgccctagacaaagcaatgaggaaaaagagaaaatgccttaacctttttcctcataccttttctttacagcatggcttctgttacagctctaattattgccagcattgtcactgtcgctcacgggcaaacaattgtccatattaccttaggacataatcacactcttgtagggcccccaattacttcagaggttatttggaccaaacttggaagtgttgattattttgatataatttgcaacaaaactgaaccaatatttgtaatctgtaacagacaaaatctcacgttaattaatgttagcaaaatttataacggttactattatggttatgatagatccagtagtcaatataaaaattacttagttcgcataactcagcccaaatcaacagtgccaactatgacaataattaaaatggctaataaagcattagaaaattttacattaccaacaacgcccaatgaaaaaaacattccaaattcaatgattgcaattattgcggcggtggcattgggaatggcactaataataatatgcatgttcctatatgcttgttgctataaaaagtttcaacataaacaggatccactactaaattttaacatttaattttttatacagatgatttccactacaatttttatcattactagccttgcagctgtaacttatggccgttcacacctaactgtacctgttggctcaacatgtacactacaaggaccccaagaaggctatgtcacttggtggagaatatatgataatggagggttcgctagaccatgtgatcagcctggtacaaaattttcatgcaacggaagagacttgaccattattaacataacattaaatgagcaaggcttctattatggaaccaactataaaaatagtttagattacaacattattgtagtgccagccaccacttctgctccccgcaaatccactttctctagcagcagtgccaaagcaagcacaattcctaaaacagcttctgctatgttaaagcttcgaaaaatcgctttaagtaattccacagcagctcccaatacaattcctaaatcaacaattggcatcattactgccgtggtagtgggattaatgattatatttttgtgcataatgtactacgcctgctgctatagaaaacatgaacaaaaaggtgatgcattactaaattttgatattgtttcaatcaaatgccactaacactctcaatgtgcagactactttaaaacatgacatggaaaaccacactacctcctatgcatacacaaatattcagcctaaatacgctatgcaacttagaaatcaccatactaattgtaattggaattcttacactatctgttattctttattttatattctgccgtcaaatacccaatgttcatagaaattctaaaagacgtcccatctattctcctatgattagtcgtccccatatggctctgaatgaaatctaagatctttttttttcttttacagtatggtgaacatcaatcatgattcctagaaatttcttcttcaccatactcatctgtgctttcaatgtctgtgctactttcacagcagtagccactgcaagcccagactgtataggaccatttgcttcctatgcactttttgcctttgttacttgcatctgcgtgtgtagcatagtctgcctggttattaattttttccaactggtagactggatctttgtgcgaattgcctacctacgtcaccatcccgaataccgcaatcaaaatgttgcggcacttcttaggcttatttaaaaccatgcaggctatgctaccagttattttaattctgctactaccctgcattgccctaccttccaccgccactcgcgctacacctgaacaacttagaaaatgcaaatttcaacaaccatggtcatttcttgattgctaccatgaaaaatctgattttcccacatactggatagtgattgttggaataattaacatactttcatgtaccgttttctcaatcacaatataccccacatttaattttgggtggaattctcccaatgcactgggttacccacaagaactagatgaacatatcccactacaacacatacaacaaccactagcattggtagagtatgaaaatgagccacaaccttcactgcctcctgctattagttacttcaacctaaccggcggagatgactgaaatactcaccacctccaattccgccgaggatctgcttgatatggacggccgcgcctcagaacagcgactcgcccaactacgcatccgccagcagcaggaacgcgtgaccaaagagctcagagatgtcatccaaattcaccaatgcaaaaaaggcatattttgtttggtaaaacaagccaagatatcctacgagatcaccgctactgaccatcgcctttcttacgaacttggcccccaacgacaaaaatttacatgcatggtgggaatcaaccctatagttatcacccagcaaagtggagatactaagggttgcattcactgctcttgcgattccaccgagtgcacctacaccctgctgaagaccctatgcggcctaagagacctgctacccatgaattaaaaattaataaaaaattacttacttgaaatcagcaataaggtctctgttgaaattttttcccagcagcacctcgcttccctcttcccaactctggtattctaaaccccgttcagcggcatactttctccatactttaaatgggatgtcaaattttagctcctctcctgtacccacgatcttcatgtctttcttcccagatgaccaagagagtccggctcagtgattccttcaaccctgtctacccctatgaagatgaaagcacctcccaacacccctttataaacccagggtttatttccccaaatggctttacacaaagcccagacggagttcttactttaaattgtttaaccccactaacaaccacaggcgggcctttacagttaaaagtgggagggggacttatagtggatgacactgatgggaccttacaagaaaacatacgtgctacagcacccattactaaaaataatcattctgtagaactatccattggaaatggattagaaacacaaaacaataaactatgtgccaaattgggaaatgggttaaaatttaacaacggtgacatttgtataaaggatagtattaacaccttatggactggaataaagcctccacctaactgtcaaattgtggaaaacactgatacaaacgatggcaaacttactttagtattagtaaaaaacggagggcttgttaatggctacgtatctctagttggtgtatcagacactgtgaaccaaatgttcacacaaaagtcagcaaccatacaattaagattatatttcgactcttctggaaatctattaactgatgaatcaaacttaaaaattccacttaaaaataaatcttctacagcaaccagtgaagctgcaaccagcagcaaagcctttatgccaagtactacagcttatccctttaacaccactactagggatagtgaaaactatattcatggaatatgttactatatgactagttatgatagaagtctagttcccttaaacatttctataatgctaaacagccgtacgatttcttccaatgttgcctatgccatacaatttgaatggaatctaaatgcaaaagaatctccagaaagcaacatagctacgctgaccacatccccctttttcttttcttatattagagaagacgacaactaaaaaataaagtttaagtgtttttatttaaaaatcacaaaattcgagtagttattttgcctcccccttcccatttaacagaatacaccaatctctccccacgcacagctttaaacatttggataccattagagatagacatagttttagtttccacattccaaacagtttcagagcgagccaatctggggtcagtgatacataaaaatgcatcgggatagtcttttaaagcgctttcacagtccaactgctgcggatgcgactccggagtctggatcacagtcatctggaagaagaacgatgggaatcataatccgaaaacggaatcgggcgattgtgtctcatcaaacccacaagcagccgctgtctgcgtcgctccgtgcgactgctgtttatgggatcggggtctgcagtgtcctgaagcatgattttaatagcccttaacattaactttctggtgcgatgcgcgcagcaacgcattctgatttcacttagattactacagtatgtacagcacattatcacaatattgtttaataaaccataattaaaagcgctccagccaaaactcatatctgatacaatcgcccctgcatgaccatcataccaaattttaatataaattaaatgtcgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccatgaatcacttgagactgaaaaatatctatagtagcacaacaaagacataaatgcatgcatcttctcataatttttaactcatctggatttaaaaacatatcccaaggaatgggaaactcttgcaaaacagtaaagctggcagaacaaggaagaccacgaacacaacttacactatgcatagtcatagtatcacaatctggcaacagcgggtggtcttcagtcatagaagctcgggtttcattttcctcacatcgtggtaactgggctctggtgtaagggtgatgtctggcgcatgatgtcgagcgtgcgcgcaaccttgtcataatggagttgtttcctgacattctcgtattttgtatagcaaaatgcggccctggcacaacacactcttcttcgtcttctatcctgccgcttagtgtgttccgtctgataattcaagtacagccacactcttaagttggtcaaaagaatgctggcttcagttgtaatcaaaactccatcatatttaattgttctaaggaaatcatccacggtagcatatgcaaatcccaaccaagcaatgcaactggattgtgtttcaagcagcagaggagagggaagagacggaagaatcatgttaatttttattccaaacgatctcgcagtacttcaaattgtagatcgcgcagatggcatctatcgcccccactgtgttggtgaaaaagcacagctaaatcaaaagaaatgcgattttcaaggtgctcaacggtggcttccaacaaagcctccacgcgcacatccaaaaacaaaagaataccaaaagaaggagcattttctaactcctcaaacatcatattacattcctgcaccattcccagataattttcagctttccagccttgaattattcgtgtcagttcttgtggtaaatccaaaccacacattacaaacaggtcacggagggcgccctccaccaccattcttaaacacaccctcataatgacaaaatatcttgctcctgtgtcacctgtagcaaattaagaatggcatcatcaattgacatgcccttggctctaagttcttctctaagttctagttgtaaatactctctcatattatcaccaaactgcttagccaaaagccccccgggaacaatagcaggggacgctacagtgcagtacaagcgcagacctccccaattggctccagcaaaaacaagattagaataagcatactgggaaccaccagtaatatcatcaaagttgctggaaatataatcaggcagagtttcttgtaaaaattgaataaaagaaaaattttccaaagaaacattcaaaatctctgggatgcaaatgcaataggttaccgcgctgcgctccaacattgttagttttgaattagtctgcaaaataaaagaaacaagcgtcatatcatagtagcctgtcgaacaggtggataaatcagtctttccatcacaagacaagccacagggtctccagctcgaccctcgtaaaacctgtcatcgtgattaaacaacagcaccgaaagttcctcgcggtggccagcatgaataattcttgatgaagcatataatccagacatgttagcatcagttaaagagaaaaaacagccaacatagcctctgggtataattatgcttaatcttaagtatagcaaagccacccctcgcggatacaaagtaaaaggcacaggagaataaaaaatataattatttctctgccgctgttcaggcaacgtcgcccccggtccatctaaatacacatacaaagcctcatcagccatggcttaccagacaaagaacagcgggcgcacaaagcacaagctctaaagaagctctaaagacactctccaacctctccacaatatatacacaagccctaaactgacgtaatgggagtaaagtataaaaaatcccgccaagcccaacacacaccccgaaactgcgtcagcagggaaaaatacagtttcacttccgcattcccaacaagcgtaagttcctctttctcatggtacgtcacatccgattaacttgcaacgtcattttcccacggtcgcaccgccccttttagccgttcaccccgcagccaatcaccacacagcgcgcacttttttaaattacctcatttgcatattggcaccattccatctataaggtatattatatagatag

---

What we claim is:

1. A method comprising:
    providing a resequencing DNA microarray;
    contacting an unknown sample comprising genetic material to the resequencing DNA microarray;
        wherein the resequencing DNA microarray comprises multiple groups of oligonucleotide probes of a length ranging from 13 to 70 nucleotides immobilized to a solid phase support;
        wherein each group of oligonucleotide probes is selected to span a region of a reference sequence that is a single gene or subsequence that represents a genus, species, or subspecies of organisms;
        wherein the reference sequence is a consensus sequence that is not identical to any sequence in the genus, species, or subspecies of organisms;
        wherein each group of oligonucleotide probes occupies a tiled region of the microarray;
        wherein each group of oligonucleotide probes comprises at least four probes arranged in a parallel fashion within the tiled region of the array, wherein the four probes are selected as follows:
            i) a first probe that is exactly complementary to the reference sequence; and
            ii) three additional probes, each of which is identical to the first probe but for the nucleotide at a central position, which is different in each of the three additional probes such that all four nucleotide bases are present on the microarray;
    hybridizing a nucleic acid in the unknown sample to the resequencing DNA microarray;
    generating a sequence of base calls based on a hybridization response between the nucleic acid in the unknown sample and the probes on the resequencing DNA microarray; and
    determining the sequence of a full-length gene or genomic fragment corresponding to the nucleic acid in the unknown sample by comparing the sequence of base calls to a sequence database containing sequences from the genus, species, or subspecies of organisms.

2. The method of claim 1, wherein the method further comprises:
    determining the identity of the drug-resistance marker or the particular class of organism species or subspecies by sequence comparison between a DNA sequence identified by the method and known sequences.

3. The method of claim 1, wherein the unknown sample is a biological sample, a nasal wash specimen, a nasal aspirate, a throat swab, a blood sample, a sputum sample, blood cells, a tissue sample, a fine needle biopsy sample, a urine specimen, a peritoneal fluid sample, a visceral fluid sample, a pleural fluid sample, a soil sample, an air sample, or a water sample.

4. The method of claim 1, wherein prior to the hybridizing, the unknown sample is subjected to at least one of process selected from the group consisting of:
    (i) isolation of the genetic material within the sample,
    (ii) enrichment for target sequences of interest within the sample, (iii) amplification of the genetic material contained within the sample,
(iv) labeling the genetic material within the sample, and
(v) subtractive hybridization.

5. The method of claim 1, wherein prior to the hybridizing one or more target nucleic acids of interest in the unknown sample, the unknown sample is subjected to at least one method selected from the group consisting of specific reverse transcription, PCR, multiplex PCR, random PCR, random primed amplification, isothermal Klenow polymerase-based amplification, Φ29DNA polymerase-based amplification, tandem amplification, multiplex PCR amplification, and total amplification.

6. The method of claim 1, wherein the genetic material or one or more target nucleic acids of interest present in the unknown sample are enriched by subtraction of the background nucleic acids from the sample, reverse-transcriptase subtractive hybridization, or selective removal of the target nucleic acids from a mixture of nucleic acids presenting the unknown sample.

7. The method of claim 1, wherein the length of the probes is 13-35 nucleotides.

8. The method of claim 1, wherein the length of the probes is 25 nucleotides.

9. The method of claim 1, wherein the region of the reference sequence that is spanned by the first probe moves by one nucleotide across the reference sequence for each adjacent tiled region across the microarray surface.

10. The method of claim 1, wherein the reference sequences represent genotypes of pathogen families, a family or group of adenoviruses, or a family or group of influenza viruses.

11. The method of claim 1, wherein the reference sequences encode a drug-resistance marker.

12. The method according to claim 1, wherein the base calls are made by determining the absolute intensity of the hybridization signals on the resequencing DNA microarray.

13. The method according to claim 1, further comprising:
determining the percentage of base calls, both as a percentage of the total tile region size and as a percentage of base calls within a selected subsequence satisfying a sliding window algorithm.

* * * * *